United States Patent 9,782,462 (MODIFIED POLYNUCLEOTIDES FOR THE PRODUCTION OF PROTEINS ASSOCIATED WITH HUMAN DISEASE) - sequence listing, part 10

SEQ ID NO: 10070 - DNA, 2041 bp, Homo sapiens
aggcgcgtagcaagagcttctctgaaagactggcagtatagtagtagtcagtgataatattgagccttaatatgttccagacactgtcctaagtgatttaccttacattattcccctgaatgtttataattcccaagtgaaagaaggaaatgatatattggatagctatgagtggggaggtttgtactggctgctttcccataaagaaattaagcacgttcacgaagggcacgtagtttgttagtgtctggaacccagttttcgtgcctgaagttcaaatgttcttgctacaccaccatagaaactaacgtcactcaggaaccatttgtcagggcaaagggtgccaccattttgcatttcctcctgccttaggaccatcctaaatcactcgcatggagtgttttggaagaactctcaagagcttcgtttgcctagagtcagaattcctaaccttgagtcctggttttgccacaaacccaagccgtttgatcttgggcaactcccgaagaaagctgggttcaacttcctcactgtcaaactggttgtaggtctagataagtttcaagtactctttttatgtgcatggtctctgacataggaagactacatactgggccagtaacaggaaggcacaaagctgactggaggtttaaaaattacttggtcaatttgattaatgaggagaatgaatcagaaaatttcaagttctcccgtggctaactgtcgagtatccacttcaagatcattccatcggaaagaggtcgaaaatgtacagtaggcatgcacaaaggataccgcctggaaagaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttg

SEQ ID NO: 10071 - DNA, 3959 bp, Homo sapiens
ctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttgattttagatgtattttctctggcttacttttgtttgcttatacttgtttatttctaaaagctaaaacaagccctgaccggaagtttcaccaggcagaaacctataggctccaccacttttgctgcctctcaggtgccacctttcaacccacttctcccaactacttatcccagctcctgaccccgaggccctggcatctactgtgaatattttttttttgaatttttatacttcgctgctcccaaatgagcaccccgagagaagtccaggcttcatgtacttgcccaggaattccttgtccccggacccggaatcacttggcctaattccggtcagtctgccttttcatttctgcaggtgatggtcaaccagtccccgtactcataggccatgggacacaagattattattatcatcattatttttaaagacagagtctcactttgttgcccaggctggagtgtagtggcacaatctcagctcgctgcaacctccaccttctgagttcaagcgattctcccacctcagcctcccaagtagctgggactacaggcgtgtgccatcacgcctggctaatttttgtatttttagtagagatggggtttcaccatgttggccaggctggtctgcatctcctgacctcaagtgattcacctgcttctgtctcccaaagtgctgggaatacaggcatgagccaccactcctggacaggccacagaaattttaaagaaaagaatcatgccaccacaagtaaacttcattttgtttatattatttaggacttcacatttgtcttccgaaaccatgaagtataattctgctaacagcaagtgttgtgaatgaggaattaggaattaggagaatggtagtacattgggaaaaacatattttagtaatttttatattttaaagataatcacagattttgctgtttgtgcatcaccaaaatcagtgagatctgccagctggtgggggtgtgcctatgagaatttttgattatgatcccctaggagggttatcaaaaaaggagatgggtgaaagatcaggagagtcgagaaattcattttttggacaacattgttttgaaggcactactggggctctgggatcaggcagccagattgaaacctggctcctccttttcctaagttatttaacctccctgtgcctcactttttgtcaaccagataagataagaaatgagagcaggtctgttacctcacaaggtggctgtgagtgttgaagacgtttgttgggggtttgggtgaagcatgcaaactctggttggtatgtggcagccactcagcctgtatttatgatgagggaggcattctaggcaccccttccaggatgttgggttgttggctgggttttactttaaaaagctcagggcctagaacattctagaatccaagtacttgctcacatatataattatttctttaggataatctttgatatagacttacgagtcaaagggtatgtaaaatgtcagcccttttacctgtattgccaaattgccttcaaaagtttctgctgttttgccctcctacccatagtgataaccttaaattggagtcaacacaaatttgagtgtgactgtgttagacagaagggatatattaacaggtaaaactggccatggcccctgcccttgtggagtatatgctctgttggttcatttcctctgcattctaattttctagacttgggatcttattgtggagttaaacaaagcacccttaaagtagcaagcgagcaaaataaaagcaaggaaaatcagttggaacataacttatgtattttttaggattaagagtaatttaactgagtcaattcaatatgtttttaaaggtgtgattcttaaattctttatgattgtttagatttctatatcttggtaacatgaatacacacttaatgaaagatttcagtaatttttgatttgggaattaatcatagtgggaaaaactgtttaggaaaacatgtcagtggaaattaactcgccacagtatgtagtgttagggaatagcttctgttcggcatttgatttgagtgctgtattctgacatttttcaggaacaaatacatgtgattcatcttctataaatatttgcagtttcttcaagttgaaatgagaaaagctcgtaaattgagcaccaggtctaataaatcattcacttacccaagaacagaaagacaggaaaagctagcatgttaatctaatgaaaaaatcgaatgttaaaaaaccaagaaagtagaagatatttgacattaactttctaatcattgataataatctaataatcataacattattcttaaaacctgaaagaatggattcctgctcccaatgtgtttttaatatcaacttaaactaaaataatttttttacctatttttggaagcttggaaattgagatgtagttgtctaatgttaacctaattaagagagcttggtgtgatttctcatatacagcatctaaatatttaagttttaatgtcttctaaaatattattacattcttcatactatagttttttaacatcctttagaaaacttgtatcagcttcactttcaaaccatgctggcatcgaactcaggtgtagtggtatcagaatgttatgaaataattttttattttcattataaactccatttttacaataaacacttctcaaccaaa

SEQ ID NO: 10072 - DNA, 564 bp, Homo sapiens
tgaacccgctgcaggccggcggaggcccgcttcagcagcggctgcgtgccaccccacagagcggccaccagcaccagagccaacacctgccctgaatgcagacgagggcggagacccataatccggaagtgacctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagctttttt

SEQ ID NO: 10073 - DNA, 1458 bp, Homo sapiens
ataatccggaagtgacctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagata

SEQ ID NO: 10074 - DNA, 2569 bp, Homo sapiens
ggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactggaa

SEQ ID NO: 10075 - DNA, 879 bp, Homo sapiens
agtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcc

SEQ ID NO: 10076 - DNA, 966 bp, Homo sapiens
acctcttcctgttcccgtccttgaggacgccgtgccgggtcagtgttagcctccagccctggttgtggaaggcgacagaagtcatggcgatgtttgagcagatgagagccaacgtgggcaagttgctcaagggtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgagtggtgacccacggcctcgggctttggggctaagggggtgcccctcaagggaggccgaggcaggggcccagaggacctgggtagatctgctcgtgttctgggctgggaagtctgcacctgccagattccattcaccttgtgtcttggggctcccgcccaggaggaatagcggggagctgggtgatcttccctggaacttctaggccctgtgtcctgccccatagcactcagcaagacttcctggggcccagcggggcctcacagggggtctctgcacccttatttgtccctgaggcctgtctcgttggccatcttttattcttggggtgcccaagcctcatgtgcagacttggaatccggtga

SEQ ID NO: 10077 - DNA, 1027 bp, Homo sapiens
ctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgagtggtgacccacggcctcgggctttggggctaagggggtgcccctcaagggaggccgaggcaggggcccagaggacctgggtagatctgctcgtgttctgggctgggaagtctgcacctgccagattccattcaccttgtgtcttggggctcccgcccaggaggaatagcggggagctgggtgatcttccctggaacttctaggccctgtgtcctgccccatagcactcagcaagacttcctggggcccagcggggcctcacagggggtctctgcacccttatttgtccctgaggcctgtctcgttggccatcttttattctt

SEQ ID NO: 10078 - DNA, 5051 bp, Homo sapiens
agttcccttttccggtcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctgttgtttttttccaacgtctcttctgcttttcttttctttggctggttgtcattttctaaacttagtaaattttcacttttatttagttgattcgtaatgaggctctgccagtcatcatcaccagaagtatttttagtcgtcttgattgcctgcaaatggctttgtagtggagttgatatcagaggctttgttttcacctgggaaagataaactaattttaccttcgaaattattatacaaaagattttaaagagtctgtaaagcctctgcagttatgagtatgtggtaaaaccaccatctcttggctgatttccactaccttagtagttctggcaccagaaaagtatacaatgtgaatgtgtaggcttatgtagtagatcttcaaaatctctaatatataactgaagtaaagtgtacaaaaactgccttttactacttcatgtttcctcccatgcttcagaacaccattgttgaagaaacaggaagggcagtgagatatttggaagttggcatgttttcaagacactgtattgggtaattttaaaaatagtgtgttaaataactttttcattttaaggttcttttctgatgttaaaatacttactggaaatttagaaaatagagtaaagtagaaagaaactaaaaatcattagtaatcccttatccagagaggcttgttgacattttggtattatttgctgctagcgtttttttctatttttagcctatttgatcattctatagaattttatgtattttcctctgtgagcagtttcttaggtcattaaaaacaattgtctatggctgcaaaatactcccttttatggatgtttgatatatctcctactactgaatgtttgtttccagtttatccctaccaaaaattaattcgagttaatttcatgcaaaacaatctttgatgtttttgagagattcccagataaaattttctcttcaaaaggaatactgggccaggcactgtgactcatacctgtaatcccagcactttgggaaactgaggcgagtggattgcatgagctcaggagtcgaaaactagcctgagcaacatggcaaaaccccatctctaccaaaaattagctgggcatggtggcatgcaactgtagtcccagctcctcggagggctgaggtgcaaggatcatttgagcccaggaggtgaaggttgcaatgagccaagatcatgccattgcactccagcctggacaacagagtgagaccctctctcaaaaataaataatagataaaacaaaaggaatactgaattgttttcaaaataacaattatggtgggctttcttttaagatagggtctcaccctgtcacctaggctggagtgcagtggcacaatcacagctcattgcagccttgacctccctggattcaggtgatcctcccaccttcacctcctgagtaccttggactacaggcatgtgccaccacacccaggtaatttttgtattttttgccatgttgcccaggctggtctctcttaactcttgggctcaagtgatctgaccatctcggtctcccaaagttctaggattacaggagtgagccatactgtgttgtgttttagttgaaagggatatacacgtgtattttagaaatatgaaacaggataagaattacattaaaatcacccaagatcccaaccaccattaaagagtttgtgtaaatcttctggtctcttttctgtatacactttttaaatactggggtcatatttttattggtttatatgctatgttaaacatttttagcatttcctcctgttcttaagtctgttaagaggatagctccatcatattctgtgttctgcaaattatttctggacatttaaattgtaagaaaatggtcactgttaactaggctgcagtgattatcatttgttcataaatctttgtgaagatctttgggtactgccttacattaaaatctttttcaatttgaccagtaaaagtggcatgttagtaacattgtcattttcagtgttagattatgtagtactaagtttattttattttatttttgagacagagtcttgcactgtcgcccaggctggagtgcagtggcgccatctcagctcactgcaacctccacctcccaggttcaagcgattcttctgcctcagcctcccgagtagctgggattacaggcacccaccacgatgcccagctaattttttgtatttttagtagagacagggtttcactatgttgtccaggctggtctcgaacgcctgacctcatgatccacctgcctcggcctcccaaagtgttgggattacaggcatgagccaccctgcccgacctagtaatacttttttttttttttttttttaatgaacttaaatgtttagaatggtaagttcacggctccctaaggagtgttccttttggattgctctgtttggctccctccctgaaatcctatagtcagccactggtcccctcagagagttttacctctgatctttggggtgattctttgttcatatttatctgattggctttgttcttccaaaagtgtctgcacaggactgctaagagaacctaggcaagtcatttaatttttctgggcttcagtttactcattagcttcttttagttcccagatgctattactggaaagaataactagtaatggataaaaacctacataaatatttcctattttgccatcaaagtgctgggttcattttggtgtatttggcatccaagtacaaattaacagtttcccaaaatcctgattctttgacttttttatcttgatgatggaaaggaaggacacgtttacttgctttagtttctttccccttaactacccacttgctgagaggggtaggagcagggattggctttagagaaacaagatacagtgtagattagctaatgtttgcgcttaacaaaacttgtcctgtttaacttacctgagggttctgcagcctaccgcagtaattttagttctagctgttttcagatatattgccttgtatcttcgttctttcgtctcctatcctttttagaaatttatcacctgtttctctttcagcctgacttacaaaatctaatttttggcctaaaaatttcccctagcttggtactagtccttttatttctgcctgtgattatattttaaaattaaacttaaatgaatctaattcattggatatataaaaaaaaaagtaagtggcttgctttgcttactctggttttccatcctcattcctggatataatcaagattgcagtaggctaacaatctaatgctgaaaacaagaatgaaaaacataccatcttttcaagttactttggacccatagagagaaagtggattggtacttaataccttccctgaatttaacagaattgatgtggactgtacataaaatatgttgaaaaataaaactatttttttggctat

SEQ ID NO: 10079 - DNA, 3978 bp, Homo sapiens
gcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 10080 - DNA, 2926 bp, Homo sapiens
gcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttactttttttgtgcacttctatgacatggaaattattgaagaagaagctttcttggcttggaaagaagatataa

SEQ ID NO: 10081 - DNA, 3346 bp, Homo sapiens
gaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgaga

SEQ ID NO: 10082 - DNA, 3045 bp, Homo sapiens
agtgttggccaggccgccgtgcggtcatggccggatggccgacgcctgcagggacgaggccgtggcggaccgaggcacggctgtgctcggacggcgagggagcgtggctcggaccgctagcgccgtggcgggaggcacgcctggcctcccggcggggaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcga

SEQ ID NO: 10083 - DNA, 1286 bp, Homo sapiens
agacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaagaaggaaaacgtcagtgttggccaggccgccgtgcggtcatggccggatggccgacgcctgcagggacgaggccgtggcggaccgaggcacggctgtgctcggacggcgagggagcgtggctcggaccgctagcgccgtggcgggaggcacgcgggccggcagggaaggccaggccgttggcgcgggaccagggaaccgcaggcgtcccggagcctggcctcccggcggggaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactc

SEQ ID NO: 10084 - DNA, 3654 bp, Homo sapiens
ctgaaatacgttgtaattgaatgaaggcttatagatctgtatgttagcagtgtctaattttggtgctctttctcgttccaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgat

SEQ ID NO: 10085 - DNA, 4001 bp, Homo sapiens
gggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatagtagaatgtggctttttcaaaagattcgttctgagccgtttaaaatgctcttgtgttctacgaagtctctttgcatccttgaacaccggggaatttccaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgta

SEQ ID NO: 10086 - DNA, 581 bp, Homo sapiens
gtgagtcggagctctatggaggtggcagcgggtaccgagtggcggctgcagcagcgactcctctgagctgagtttgaggccgtccccgactccttcctcccccttccctcccccttttttttgtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaag

SEQ ID NO: 10087 - DNA, 555 bp, Homo sapiens
agtcctgtacacccggccccctctcgcgcgtctttccacgagctctccacggggaggaggcgaaagggtggacaggggaaaactgctgaagagctttcggagagacctcatctagtcgctggcctcgtcaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaag

SEQ ID NO: 10088 - DNA, 591 bp, Homo sapiens
agcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactg

SEQ ID NO: 10089 - DNA, 1969 bp, Homo sapiens
aaagagctgggcgccgggctggcgggggtggcctcagctgctcctccccgtcgagcgacccgggcctcgcggggaggttgtcggaagcacttccctaacttgcgcctgggtgggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatagtagaatgtggctttttcaaaagattcgttctgagccgtttaaaatgctcttgtgttctacgaagtctctttgcatccttgaacaccggggaatttccaggtggctaaacaaaatgtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccagattagcctgaggcctgctcagtcgttcctaatg

SEQ ID NO: 10090 - DNA, 1069 bp, Homo sapiens
aggcgtcccggagcctggcctcccggcggggaggtgtgtaggacctggagtcggcaggggctgcccttcgtcggggaggaaagagagagtgatgatttctgccccttttgtcagcagaggaggccgtggcgaggcggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgct

SEQ ID NO: 10091 - DNA, 573 bp, Homo sapiens
agacacgccttagcgccagcagtgagtcggagctctatggaggtggcagcgggtaccgagaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctc

SEQ ID NO: 10092 - DNA, 1877 bp, Homo sapiens
ggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcc

SEQ ID NO: 10093 - DNA, 909 bp, Homo sapiens
ctagtttctaaggatcatgtctgcgagccaggattcccggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgagatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggac

SEQ ID NO: 10094 - DNA, 1169 bp, Homo sapiens
ctagtttctaaggatcatgtctgcgagccaggattcccggttatgatgtgattgctcaagcccaatctgggactgggaaaacggccacatttgccatatcgattctgcagcagattgaattagatctaaaagccacccaggccttggtcctagcacccactcgagaattggctcagcagcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacagaatcggtcgaggtggacggtttggccgtaaaggtgtggctattaacatggtgacagaaga

SEQ ID NO: 10095 - DNA, 1645 bp, Homo sapiens
atgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaa

SEQ ID NO: 10096 - DNA, 1919 bp, Homo sapiens
tataaaaaacgggtggttgggcgccgctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggt

SEQ ID NO: 10097 - DNA, 1726 bp, Homo sapiens
tggtttttcggatcatgtctggtggctccgcggattataacagcagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcacttt

SEQ ID NO: 10098 - DNA, 1889 bp, Homo sapiens
cttttcagtcgggcgctgagtggtttttcggatcatgtctggtggctccgcggattataacagcagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaa

SEQ ID NO: 10099 - DNA, 480 bp, Homo sapiens
gaacagcatctccggtttccgcctccggctccggcgcggctcccccggcccgcctctgcgtcagggacgcggaaaccccgtaggagcagggcgggcggggaaagcgaggtttaactaactccgcagctatattcttccgccgcgaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttcc

SEQ ID NO: 10100 - DNA, 600 bp, Homo sapiens
aaagcgaggtttaactaactccgcagctatattcttccgccgcgaggtaaagagtcccaacccaaccccgggccctaggatttccagcgaccctgtaatatcgagaaattaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgag

SEQ ID NO: 10101 - DNA, 7257 bp, Homo sapiens
gccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgctctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagccaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaactcatctttagagtacctttaaatgaattttgtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccagaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 10102 - DNA, 1604 bp, Homo sapiens
tgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaacta

SEQ ID NO: 10103 - DNA, 3448 bp, Homo sapiens
gaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgattgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaa

SEQ ID NO: 10104 - DNA, 1372 bp, Homo sapiens
actccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaagtacgtgttggggggttatgggaggacgtgtccctaagcttagtataagtagatctgtagttgggcccagaggaatatggccggacaggagacttacttgtggagaagggacagaccaggccttccctctagggcttctggctacttgctgcagttctttgtcagcgaggctccctgccacctatactaccaggtgctttgtagcagagagagcccatctgcagaaacccagttgtactacctgggcttgcttaatttctacaggctgtcttgtctttcatatgctaaccactatcttaaaatgaaagacaagtgcttttctttttcttgctgttttttaagataatttcaccctgcccaccctcaccccacttctgcatgtctttttaacttgttagcttcagtctattttctttgtcctgggatactgactacttatcaggaatgactccatttccttgtgtatagagctgactcttagaagaagggggatagtgtgtgtgtgagagagcagaatcaaagggaagcatgaaggccacagggaaaataagcttggcaatctccctaggactcagggaaatagagctctctgtccacagtgagaatcactgttaggcttgctcctcagtgattgagtgtcagaagtaagctcaggctattgtgaaaaagtgtggggagtggctgtcagattgtctcaaagctggagggagagctagccagctaagagttaggactcttaggtttagttctctcatatggccccataccaatatgtgcctttgacaagtgtctttgcaactttgctt

SEQ ID NO: 10105 - DNA, 2764 bp, Homo sapiens
gcgcgcagcgcggccgccgccgccagccccgccgaggcatcccgcaccgcctgggcccggctgggctgggggcgcctccgcagcagccgcggggtcgggaggcggccgggagggaggcagggcccaggacgcaaggtggcgacaagtcgcgtttggccccaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcac

SEQ ID NO: 10106 - DNA, 6083 bp, Homo sapiens
gctgatgggattaccagctcctgctaattgcatatgagtgctcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgttcacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 10107 - DNA, 777 bp, Homo sapiens
agttggcggccgcctggccggtggcgcccgggccgtggaaggtccagtcgtggctgacggcgggcaccaggcgcgcgggccgcatcttgcggcggtcgtggatgaagaagagcaggcggaggtagacgaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaa

SEQ ID NO: 10108 - DNA, 6076 bp, Homo sapiens
cggagaaaatggcgctgcccccggccgccgcgccccccgccggggcccgggagccgccggggtcccgcgccgccgccgctgccgccgcccccgagccgccgctcggcctgcagcagctgtcggcgctgcagcctgagccgggcggggtcccgctgcactcgtcctggaccttctggctcgacagatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgttcacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatgaa

SEQ ID NO: 10109 - DNA, 6205 bp, Homo sapiens
aaggcggcgtggaagcagaagagcgcggccaggaaggcgagcagcttgcagcccagcgcgcccggcggcgcccccgccgcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgttcacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 10110 - DNA, 519 bp, Homo sapiens
ggtgactggatgctggaggggaggggagtagctgctgcagctaattgcttaattatttatgagtgcctcaagtccttcttgttgtttttgttgctaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacag

SEQ ID NO: 10111 - DNA, 613 bp, Homo sapiens
ggaaggcggcgtggaagcagaagagcgcggccaggaaggcgagcagcttgcagcccagcgcgcccggcggcgcccccgccgcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcag

SEQ ID NO: 10112 - DNA, 693 bp, Homo sapiens
gtagaagagagaggaccacttgttgctaggcaaccagcacccacctcacccatgttgccatggtgatgatgaaagttgggctgatgggattaccagctcctgctaattgcatatgagtgctcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccc

SEQ ID NO: 10113 - DNA, 3544 bp, Homo sapiens
ggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatg

SEQ ID NO: 10114 - DNA, 3111 bp, Homo sapiens
gagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaagcgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagcagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaagtaa

SEQ ID NO: 10115 - DNA, 2151 bp, Homo sapiens
ttttcttcagatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtc

SEQ ID NO: 10116 - DNA, 251 bp, Homo sapiens
gcgcgcggcggggaaggcggcgccggggccagggtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctga

SEQ ID NO: 10117 - DNA, 374 bp, Homo sapiens
gttcacagggagtggaaaccggaacccgtggagtatgacccgcccatgcgtggacccggcaggttgctacaacttgcacttggaggggagaggtcccaaggcccccgaattagaaatgccaggctcatctctttttgtaacccttcattttaaaatgtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctga

SEQ ID NO: 10118 - DNA, 3420 bp, Homo sapiens
gtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtg

SEQ ID NO: 10119 - DNA, 3695 bp, Homo sapiens
gcgggcgccggggcgcccgcagggggtgggcaggggcgcgaggcccgcaaggcggccggcgggtagccggcgggctggctggcggggaccgagccgccgggccggggaggacggctgcgggcctgcgctagctccagcttgaagcgcccgggccgggagattcggcctccctcctccctgcggccggccgcccctcagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaa

SEQ ID NO: 10120 - DNA, 1530 bp, Homo sapiens
attaagggggagggggccgaagaggaggggcggagggccgggctgcagttacggcggctgaagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagcttgagactgtctccaaaaaaaaaaaaaaaa

SEQ ID NO: 10121 - DNA, 688 bp, Homo sapiens
tggccacaggtgcggctggcctggcgaggggcgctcgggccccgtccccagtccctgatcgccggataacaaggggcagctggcgccgtccattggtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggactt

SEQ ID NO: 10122 - DNA, 2679 bp, Homo sapiens
gcgcgcgcgtgcgcgtgcctgcgtccaagggatttgcgatcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaa

SEQ ID NO: 10123 - DNA, 2503 bp, Homo sapiens
ctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 10124 - DNA, 5945 bp, Homo sapiens
tctgggaaaggcggggggaggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaa

SEQ ID NO: 10125 - DNA, 3417 bp, Homo sapiens
gggggcggcccgatcccggcacccctcggccgtgtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaaagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttga

SEQ ID NO: 10126 - DNA, 872 bp, Homo sapiens
gcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatg

SEQ ID NO: 10127 - DNA, 719 bp, Homo sapiens
aggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctg

SEQ ID NO: 10128 - DNA, 4384 bp, Homo sapiens
ggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaa

SEQ ID NO: 10129 - DNA, 583 bp, Homo sapiens
gtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgt

SEQ ID NO: 10130 - DNA, 678 bp, Homo sapiens
gtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttg

SEQ ID NO: 10131 - DNA, 580 bp, Homo sapiens
gacgctggggccgagggtagcttgagcgcggcggcggcgttgttcagtcagagcgagaacattccagagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaa

SEQ ID NO: 10132 - DNA, 723 bp, Homo sapiens
agtcagagcgagaacattccagaggtgagtccggtgaaggggcggccccctgcccggtgcttcccgccccctcgacccctcgggccgctggctggcggggaaggtgcactccccgaccgcccacggctcacggcgccgtctctccgcgccaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgt

SEQ ID NO: 10133 - DNA, 569 bp, Homo sapiens
gctcgggctgactcaggcttcagctgctgcatttagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttg

SEQ ID NO: 10134 - DNA, 1256 bp, Homo sapiens
accacactagcgcgctagaagagtggggcggaaagacatctcccgcgcatgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaa

SEQ ID NO: 10135 - DNA, 1519 bp, Homo sapiens
gggagggaagatgaggttgaagagattaaaaaaccgggtgcgcctgcgcgttgcagattagttgaaaacgctcagggtttgtgaggggcggggtcacgtatgcgcgtcattggacgggtcggtgggagggagggtggagatgggtagggtgtgtgcgcttgcgcagtgcgggggtggagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaa

SEQ ID NO: 10136 - DNA, 923 bp, Homo sapiens
attgcgcaggcgcaaggactgcccggtaggacgagcggtctatcaaggggagggaagatgaggttgaagagattaaaaaaccggttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccattcagacaactacacctgctccccagtcttcagcctcttctgtggttacccttctgtccccgcatcattctctggcagtccctccgtttctccagctttgtgccaatctcttcaattcataggcctttatgctctagctattcagttgctccttccttattcttggttttcactttttctttcttcccttgagccgttgttaagtggttgcttccatcacgttgcccagggtttctccaattctacgccttcccctggagggactcctgcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgctagcacttccctcatcacctcagacttttcctgtctctttagaatttcaacctgattcgttcttgttgaatttcttgt

SEQ ID NO: 10137 - DNA, 1340 bp, Homo sapiens
gagccggcagcccctagcgcggggagctagtcctcgcgggggttccgagggggcctgagattttgaggagtggaagccggaggctcgggtcctaatcaccccggagggcctgctgcaggcatatgttagcgcttcccaacctcaagggccccaggagctttcctgaaaaaccctcctgtgaagtgtggcggtcagccaggtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaa

SEQ ID NO: 10138 - DNA, 1284 bp, Homo sapiens
agggcgggggacggcgagccgcgaggcagccacgcgggagaggccgccaggcggccacgccggggcgagggccaggggccagatcggcccaccggggcaagggtacctgggccgttgaggacccggctcagcgcggccacgtgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaa

SEQ ID NO: 10139 - DNA, 5593 bp, Homo sapiens
gggtaagggcggggaggctggggtgtggaaagtgtggcggccccgccccgtctcttggaactgccgcggccgccaccgccgctgccggcgccgctgctgtaggggaccagcgcgggtgcgcagacgaaaggcgctctttgccagctgaaagttcccacggaaaaactaccatctcccctgcccaccatggcagacgaaattgatttcactactggagatgccggggcttccagcacttaccctatgcagtgctcggccttgcgcaaaaacggcttcgtggtgctcaaaggacgaccatgcaaaatagtggagatgtcaacttccaaaactggaaagcatggtcatgccaaggttcaccttgttggaattgatattttcacgggcaaaaaatatgaagatatttgtccttctactcacaacatggatgttccaaatattaagagaaatgattatcaactgatatgcattcaagatggttacctttccctgctgacagaaactggtgaagttcgtgaggatcttaaactgccagaaggtgaactaggcaaagaaatagagggaaaatacaatgcaggtgaagatgtacaggtgtctgtcatgtgtgcaatgagtgaagaatatgctgtagccataaaaccctgcaaataaacggaaacatcaggcatgaacactgtttatgtctgaatcaactgcagatctaatttggttctaagttgtcaccaaagctatagccttcataagcaacctcatttctttttttaattgttttcagattgtgctgggttagttttgcaagcaattgataatttttaaaaaattatcaatatgtataattttttttgaattttgtagatatgtttcctataatattcctgtggttttcagtatgtcagtccaagaaacaaacaagatagcttcagcagatgtgatttgtctgagcaaatcattcctgtgttttagttagatgataaaccagggttttaaatcaaacaatgtagcataaagtggtattgaagtaccatatttaagttgaactgctctgcattaattacagatttaatataaaatgaactgattatatattggaattgttgcactttcagcctgtgtagggcaaacacaaatccttaaacaaaaatcatgttatcaaaaactgtcagttattttggtggccacatgcaaccatgtgattactttggtcatactatttaccaaattgttggcaaacttgatgtaaccttatatggtggttttagtcccttcttatggttggcagaagggcactgaactgttgggtgaaagttagttagcaagtaagattataaggaagacacaaaagacagtggcaaagagggttgattaaatctataagtttttatgtgaggactttgtaagtcagcataaaaatgaaaagttgtttctcagttgtttttgcttttaactttgcccccaacgtttaaagggagtgatctgctttacatgatactatgcaatgcttgttttccaactatgttgaataaatagtaatatttatcagtaaatactcctttccaacttccttttttttttttttttttttgagactgagtctcactccatcagccaggctggagtgcagtggtgcaatctcggctcactgcaacctctgcctcccgagttcaagcaattctcctgcctcagcctcccaagtagctgggactacaggtgcatgccaccacgcccagctacttttttgtgtattttagtagagatggggtttcaccatgttgtctaggctggtcttgaactcctgacctcaggtgatccacctgcctcagcctcccaaagtgctgggattacaggcatgagccaccacacccagcccctttccaaccatttctaagtagattttttgacattaatgtatttattaaacaaaaactgagaattccttaaattgatttggaatttttgttaattttatgtcctttttttcctaaagtgaattaaagtgaatcatggaagcagcattactttatatgaatattattatttaagttaagttattttaagtatatgcattttttctgattgttgtgtgacttaattcagttgctggtgtgaactataactagcaaataattctataaactgaattattttaaaaggtattttaggtgacaccactgcatttctatttcatcttttgagtcatatgtatattatttccagaattttagacattattacagggtttgtgaggacctttgactcagtgacaatcatcatattggagcaaaacatagaacaaaatcactatctcagaaataccttaattctctaagactggctcttagacctctcccatcatgccttgacctctaaaaagccctttgttcctatcttctaaaggaaagtatatcatatatgatgatgtaactgatctaatcagtgactggaaatagcattagtaacagaagatcccaagttttagttgcttaatttgtacacacttttaaatattgtcttagcctcggcaaaccaatttggggaagaagcaagatactttaagagaaatacaaaggaaatttctaaagcacaagaaatagtgaggtagtagttagtcgtctttcctacaacattttagcttttgcccatctaaagcacaattaaaattaggctacattctttccagtattctatttaagtacctactacatactgctctagtttcttagtactctgtaatgtgtatcttaattgctactggttggcattgtaactcataggaattccagaaaattattaatccgtgctgcttgcagttcattcatatggcccctcttaaccatgctggtgttatgattcagtattaactctcaattagcatgcccctgttcttcctaacttgtaaaatttcacataaatatattttcaattgtgtacaaattaagggtgtacaaattataataatgcatctctatcttcatactttgaatggcaaacgctatttatgcataaatattttcattttaagtaatatatgaagtgtaaatactcgatatataagtatagattttaaagatatgggactttattttcacataagtcaatagatgtttctctagaacaaaatatttagtaaagctttataaattatattaaaaggaagcggggaacatgtattttttaacatagaacagaagtgacttcattctttttagacatcagaaatgttaaagttgattcccaatatttgttgtacttttttgtagcaaatgttaaaaatcacgagttaccatgtatagaatgtggactgtcatgttgatatcattgtacagtgataagccatttttatctgtatacatttcaccaatttattaacaggttgaatatttgtttctttttagaacattttatttatactgtgaagactttgttataccttatttgctacaacatagatcatatcattgctactttgacttagcatttgcatcataaacataattatgatgtttttttcatgctcccttccaggggctcagtcacttgaagaaactgttgctaaccaagctcttgactctgtttcccttaatgatacaagtctctgtaccagcgctttatgttaattaccaaaactctcctgcatcagagcatgatatctataataggagatactgcaataaaatgattaggctgtaaaatttggagacacaatttttcattacaatgcaatttgcatgtgcacatgtgcgcacataactttatatgttagttcttttttccaaactcccaactcttaaaagtattgtagtctgttggtgcctcaactgttggtaactttttttttttaaatttacaactttccacaacttgtttttgtactttaaggtttctcaattagaatatttctagttgagctgtaatttgaatgcattgttctcagggctatttgtgctaaaagctgaaatttcattattttaaagctaattgcctgaaaatatattggcagaattttcccaaattgtaataactgtgatacatgcatataaaaaaatccttaatgtcaacacacttaaactacatgctaaatagtcaagaaaaaaatggaaacagtagcatccatactggaatcttgccatatttttttcattttagaatagattttggcagtctcatcttagaatcctatccttaggatacatctgaaagcattcctttggcatggaccccagagatagttttggagccaggcattgatgtagaggttcaccaaacatatttagggataatagataaattcataatgcttttttgggtacactgaaatgtttacatactgaattctgtaatatgaactaggaacgcatttactatgagaaaatatggctcttaagcagtgtaagagtgaaaatataagcatatttccattaacagtatattgtactgatcagcagctctcattttaacatcagttaggcataatatttcatagttttcaagccttttttttctgctaacattcagacaagtaacaggcaacaaagatttaagaaaaatttatggtggaaaaccttaaaaattgagacaattcaatctatttaatctattaaattttttctctgaattgggtatatggcatcattatttgattttagcagggaacatttggatttagcttatgaaacacagatgttctatgggaacatggcttgaagccaatatgtaatttaatgtttttccattaaacaaacatctgaacaccaacttagctaccaagtgaggtcaagtgcctgaaaagtactgtatacatctaataagcatgttttccttatgtaaaagatgcactttatggcaatgcataccaggctttcacctgctagaaacatacttgttgccaactttgccatctaccactattctcctccttagaacaggtagaaacctattttacaaaaaaaaaaaaaaaaaaaaaaagacaggttattgtatttatatgaagtccctaaaactgtttcttggtattgatagacttaagtttatcttagttcaagattgcactttttaaaaaactctggactattttcagcaatgaccgaacagcttgtcacacatcatagttgtgatcttttttgaggagttatttattgtggttaatatctactataaataagcattcttgtgcttgttacaaagcataatgcaaattactagttctatactagtataatgaaaatgactagttctatactgttatgtacttttgtcttcctccccaaaaaggaaacagtttagcattgtctaaattcagtggcacttttttagtaatacatttttttttcttagatacaggagaactattgcttttacctgcagaaactcaaatgttttcgctaaaactttaaaattctaaaatacgtagtatgggtattactaattgtacattttacatttcaaaaatagttaaaattcaaatgttaagtctttgacttaaaaaacctttaaatatagataataccttaacaattataactttgtgatattattaaaatatatttgtctgttaacttcatcagttgtattaaataaaaatagttaacagcttgcacta

SEQ ID NO: 10140 - DNA, 1252 bp, Homo sapiens
gtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 10141 - DNA, 1017 bp, Homo sapiens
tccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 10142 - DNA, 1289 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 10143 - DNA, 551 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcacca

SEQ ID NO: 10144 - DNA, 3742 bp, Homo sapiens
actcgcaccggccccctcccttccgcctgccgccttccactccgcccctggcggaggaagtgatgtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaag

SEQ ID NO: 10145 - DNA, 3874 bp, Homo sapiens
gccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctgggtagtagcccctgacccaggggcgagggtcggcgcggttggcccgagaaggggtcctttccccgcatggggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaata

SEQ ID NO: 10146 - DNA, 1736 bp, Homo sapiens
atagtagaatggcctgcctcaggccatgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacagcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaa

SEQ ID NO: 10147 - DNA, 2713 bp, Homo sapiens
ctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgccaagggggaaaggagagggcggaaaaggaccagcgggatccggccgcaagaattggaaagcctaggaagtggcggtggctggcgcgtttggggagcaggagtggggatagggaagcagagcttgagagaccttcctccggggcagcctccggacccaccgccccccaccagggtcgaggctgtagctccaaagctaaacaaaacttagcagcaacagcaaccaatatccagtccctcggcccctcggcccctcaccctccacctcacactcccttctcaccgggccccctctccccagccaaggcccaagcactggaaagggaaattgctgtctctctgaacaaaatgctgtgtatgcagagcaggtagagattaatctttgccagcttttccaaggcatgacaaggggctggtggatggcaacataccagtcatttggaggagagagtgagagatgatttactaccagggagaatccagccccttggcatgggacctggagcctcgactacacagcatcttctgggtctggcgtctgccagcacctgatctctttcctcattcccagctttgtgacacttctcaacttgcggctccatctctccctgcccccacttttttgttggccagggaggctgcagatgccccaggagccctttgccgcttctatgaggccaagccttttttccctgggcccagcacacaccctgattagcaagtgatgtgtgcgaggagggtttgtgaatgttgaatgtgtaataatgatcaccatggagctggccactgaccccagagctgagctgttaacaaggcgcccagggaagagcttagggagtgggaacttcacctccctctctcggtatctggcggtaaattagaggcaattttcatccttt

SEQ ID NO: 10148 - DNA, 1635 bp, Homo sapiens
cggacaccgagtcggatttctatgaagaaatcgagcctccttcccataaccctcagaacaacctggactccactcacatatactaagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgccaagggggaaaggagagggcggaaaaggaccagcgggatccggccgcaagaattggaaagcctaggaagtggcggtggctggcgcgtttggggagcaggagtggggatagggaagcagagcttgagagaccttcctccggggcagcctccggacccaccgccccccaccagggtcgaggctgtagctccaaagctaaacaaaacttagcagcaacagcaaccaatatccagtccctcggcccctcggcccctcaccctccacctcacactcccttctcaccgggccccctctccccagccaaggcccaagcactggaaagggaaattgctgtctctctgaacaaaatgctgtgtatgcagagcaggtagagattaatctttgccagcttttccaaggcatgacaaggggctggtggatggcaacataccagtcatttggaggagagagtgagagatgatttactaccagggagaatccagccccttggcatgggacctggagcctcgactacacagcatcttctgggtctggcgtctgccagcacctgatctctttcctcattcccagctttgtgacacttctcaacttgcggctccatctctccctgcccccacttttttgttggccagggaggctgcagatg

SEQ ID NO: 10149 - DNA, 4203 bp, Homo sapiens
caatttttccgcctccctccgaaagcgataataatatttagaggcgttcgctggggctgaatgagaattagccctaggcgcagcctatcattaggacgggacagcagggccactgtgacatttttaagaaagctgagatgatggaaagaataagaaaagagatgattctgatggagagagggctgcacagccctacggcgggcaagagattctccaatttgtccaactcggctggcaatgctgtgctcgaggccctggaaaattcgcagcacccggctcgcctaagcccgcgcctgccgtctgcccccctgcacagcgctctgggagaactccccgccaagggcaaattcgaaatagacactttgttcaacctgcagcacacgggcagcgaaagcaccgtctcctccgaaatctcctccgccgccgagagccgcaagaagccgggccattattcagaggcggccgctgaggccgacatgagcagcgacgtggaggtgggctgctccgcgcttcgctcccccgggggcctcggcgccgctcagcttaaggaaaacaatggcaaagggtacgcagagagcggctcggctgccggcaccacgacgtcggcgtcgggctcaggcctcggaagcctgcatggaggcagcggaggcagcggcgggagcgcggcgctgggtggctccggctctggcgcggatcaagtgcggcgctaccgtacggcgttcacccgcgagcagatcgcgcgcctggagaaggagttctaccgggagaactatgtgtcgcggccccgccggtgcgagctggccgcggcactcaacctgcccgaaaccaccatcaaggtgtggttccagaaccggcgcatgaaggacaagcggcagcgcctggccatgtcctggccgcacccagccgaccccagcttctacacctacatgatgacgcacgcggccgccaccggaagcctgccctaccccttccactcgcacgtgccgctgcactactacccgcacgtgggcgtcacggcggcggcggccgcggctgcagcctcaggcgcggcggccgcggcttcgtcgcccttcgctacttccatccggccactggacaccttccgcgccctctcgcacccctactctcggccggagctgctgtgtagcttccgccaccctggtctctaccaggctcccgcggccgccgcggggctcaacagcgcggcctctgccgcggcagccgcggcagccgcagcggctgcggcctcctcggcggcggcggccggcgcgccccccagcggcggctctgcaccctgctcgtgcctcagttgccacagcagtcagtcggcggcggcagccgcggcagcagctgccgcagccctgggttcccggggtggcggtggcggcggcggtggtggtggtggcggcggcggcgggggcgccggggccgggggaggctcggacttcggctgcagcgcggcggcgccgcgttccgagagcggcttcctgccctactcggccgcggtgcttagtaagacggccgtgagcccgccggaccagagggacgaggctccgctcaccagataactacgtcgccaccgccagggggccgcgcccgcctctctgagtgtgcccgggagtcccctgtgcgccccctgagccctccgcgcgttgcccgctgctgccgctgccgccagggggcgccccggggcgcgggaggccgaagggaacctgctccgaattgggggagaaggagcaggcgcaaaagcctggcgggcatccccctaaattatttctatttttgtatttgccacccagccgtctgcccttctctctcttttctggctcccgggacccactttccacctctgtcctgagcgcttggtttcccaaagaccaacccctcgccccctaagctagtcctggctgtgcactctcaggtccgggttgcttggctgaacggcgtggcccgaagcaacggagaaccacaacaaagacagagggggatgctgtgcgctggtgcttgggggcgggggaggagtcgccccggaggtttctcgctgctgctgtttttcttccttttctttcaacgagggtgggggaggtggcaaacgttctttcagcctgagcttattagggaccctgcccgaagagtgcgggagaacggaggtctgataaggccgggaggacggatggagagcgtgggcagcggtggttgtttgtgagattgtttactacgttcaggagcaaggcgggtagggatgtggccgccttccccgggaaggacaaagccgaggtgctggaaggggtggccgttgcgccgcctccttttcggtccaacacctttctctcttttggtctttggtttcagtgctgatggaatggaagcatcttgcatattttatgcaaaaagtgatggcaaaagaggttgccacggccagggaagggaaaggaagggagttggggtaggggtaagactgatagatcgctgtagtatttggagaggcgttttcagctcagttttccaactaccgggttccactcgatctgggaaatacttgaatctctagatatattaatattatcctaaagcatttccttagacacttttctaagttagaactctctatgtccctcgtccccttctctcctcgctttccttttcctcgggtgaaatggttcttggcatatttctcacgcatgtctattgcgccttcgcctctgcaaagccaccgctgggttgctgagacccgctctgccaacccggctactggaggggtttccttgaacttgaagaaaggtacatcaaaacccactagtgttaactgccacgtcaagtttgatgctaataatgtgcagattatgacgaaaattgccaatcatgctctctgatggacctcctttgaatgtggaattggagaaaagttccccgcacggagacctgctgtcaagtactaacaacccgctaagggaagtcattaggagagacggataagagactcggtacataaaacattgttcttggtgcatagaatgtatgttatttaatgttatctctgttacctgaagtgatttcgcagaagaaagccacgttcttatcatctcaattgccgattttcattttggtaacttggacgccctgggtagacttttctctgttaagttgatattccaccagtgtgaacagcctcattaaatcaagcccagatatttccataatgctccccgcagagccacttggctcctcacataatgagattttctgaagagttgaagccctaaaataacttgctagtgcatgtttagacccagcgaagtgggtatgtgtgtgtacgtgtattaaaatgtaggtaggctacctacatgtgtttgtgtatgtgtatatatatgtatatgtatgtatatgcatatatatatccgtgctcttaaatacatatgtaagagatacacacatattcatgtatacatacacattggcactattttctgtggtttatttcagatttgtgtcctgccatcatattgttattttaaagacactggattttaaaatatcatttcctaaatataggctttcagtaaacttttgaaagaattagttttccaggagaaattatttccatcaaatggaaaatacataaaggggaaacagtatttcgaaattcctggggtctattaaaatattaccataaaatattagagaactttccaatgaaatagcaatgatctaaaacttaagtttttgtttttgtttttaaaaacatgagactacttatgtaaaatattgattataccagctcttattcactgagtttacatttttaaaaatattaatatataatttaaggctaaataaaataaaccaaaatatggtaccctttatcagctttacctatttagattgttaaagtcctttgttatgatcagctaacagatgtatataaggtactttaggcagtaatgtttacatttcccccaaaaaatatatatgattgatgagaacgctggttggtaaaattaacataaattcatcatttgttgggtccattggatctggttattatattgaaataaaattgtaaataaagtcttcgtgctttaaatattgctggatgtatgaactcactgtaagatattttacaaatgtgcaataattataaagccttgtatattacgttatttattgtgtttggtcatgtaaaataaatgttatttaaatcaa

SEQ ID NO: 10150 - DNA, 3418 bp, Homo sapiens
cttgcgcgcgccccaccgaccaaaatggcggctgccgttggtgcggggtgcggtttgtagtgctgttgccctactcatccctttgcaaaatgtgaaagaagaagcggctggtggaggcgggccataggcaatgagtcggcgaaggaaacatgatgacagccctagcccgaagaaaacgccgcacaaaacagtggcggcggaggaatgcggctcggtggtcgagccagggaggaggcggctgagatcggcccgcggttcgtggccctgcggggctagagaggggcctcccgggccagtgcggcagcgagagcagcctccgaccgccgccctgtgcagtaaaagtaaccccgaggaaaggtatgaaacaccaaagagagcgctgaaaatggactcactgtcatcttccttcagttctcctaatgatccagatggacagaatgatatcttttgggatcagaattctccattgacaaagcagttaggtaaaggaagaaaaaaacagatttacaccacagatagtgatgagatttcacatattgttaatcgtattgctcctcaggatgaaaaaccaacaacaaattctatgctggacatgtggattggtgaaactgctattccttgtactcccagtgtagcaaaaggaaaatcaagagcaaaaatcagctgcacaaagttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgtagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacgaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagttagtagagactgtttttgtagttttactttcattaactgttgcttaaggtttttatacacttccagattttaattaatactttcatatttctaggaacatggttgatatgaaataaaggactttttatttgtaaggaaa

SEQ ID NO: 10151 - DNA, 2750 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagt

SEQ ID NO: 10152 - DNA, 2920 bp, Homo sapiens
tgctgtagctgccatgggcaaaagagaccgagcggaccgcggtgagacgttgcgcgggcacgctcagccacgactgcccttgccggccctgccccccgctctgcctcggagctgctccgggcctctgcgccggccgaccctgctggccctcccgcgcgcaccccgttgggacaggcctttgggcgggagagatgctggacctgggcgcagcccagcgaactcggcctaggggagacgggtgaggggcgcaacgcctgcgggatgcaggtggctcttagctaggagtttgcggcggcgcagacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattg

SEQ ID NO: 10153 - DNA, 4243 bp, Homo sapiens
ctctccacggcgcacagagcatgcgcggggcgggagtgagcgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaggaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaagtgtt

SEQ ID NO: 10154 - DNA, 3357 bp, Homo sapiens
agtgttgggggaacggccgcttcccgttcaacgctttattgaggggcgtatcctagtggcccccatccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgacatttgataatatttt

SEQ ID NO: 10155 - DNA, 3248 bp, Homo sapiens
atccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgacatttgataatatttt

SEQ ID NO: 10156 - DNA, 3551 bp, Homo sapiens
cttccttctctacgcggtcaacttccggcgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaa

SEQ ID NO: 10157 - DNA, 2680 bp, Homo sapiens
gtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctc

SEQ ID NO: 10158 - DNA, 2310 bp, Homo sapiens
cagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcag

SEQ ID NO: 10159 - DNA, 424 bp, Homo sapiens
cggcggcggcgtagccgtagaggattttctacgttggtatgccaaatttcataatcagaaaataaagagaaaggaaaggttgcaatgtaggtccagatgaaaaaggagaagagaggtgtctgaaagcatgtgggcatggagaatgaaaaattccaggagaagtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccct

SEQ ID NO: 10160 - DNA, 2825 bp, Homo sapiens
agtgcccgcgcgctgtccacttccggccgggaccccggaggcggaggcagcgaaggcggagggggcggcgggggcggcggcggcggcggcggcggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaatgaaaa

SEQ ID NO: 10161 - DNA, 2247 bp, Homo sapiens
gagcctcggtgggaagaaggggcttctgggtggggagtgggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggctcttccttcccaggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactgtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagagggctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctccggcctcctgcctgccctcggggtcctgcgcccgagccctgctgctcgcagaataa

SEQ ID NO: 10162 - DNA, 2497 bp, Homo sapiens
ctttctgttgatggccttggggagggaggagcctcggtgggaagaaggggcttctgggtggggagtgggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactggtgtgtggcagctggcccaggccattgaggtggtgcagggaacccgggaggccctgagccaggcccgtgggttgctccagggcatgtcccaggccttacagactctagagcccctacgggagcgggttgcccagcacaagcaactgcaggccctgtctcacctgctgcctcggctgcgggcagtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccaggcaagtgtgtctcagtggctgcagaatgcactggatggggaggtagctgagtggggccgggagcatgggcccaacacagacccgtctggctcctattactcaccaatgccagccattgtgctgcagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttgggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccgga

SEQ ID NO: 10163 - DNA, 2278 bp, Homo sapiens
ctttctgttgatggccttggggagggaggagcctcggtgggaagaaggggcttctgggtggggagtgggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactgtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagagggctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccgg

SEQ ID NO: 10164 - DNA, 4185 bp, Homo sapiens
ggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccctgggacagttttgtatgctgtatcttgtacacaggttgtaggttggtttattgccattttgttttatttctgctgtataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagctta

SEQ ID NO: 10165 - DNA, 1604 bp, Homo sapiens
ggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggtagcggcgaagaaatccaccagaaagacaatcaaagtaacattaaaaagctcaaattttacaaaagttaagttcctgccaacattttcaatttatcatacaattagaaatgtgactcagtctaacaacacccaagaggataaaaggattaaaaaaa

SEQ ID NO: 10166 - DNA, 3020 bp, Homo sapiens
ggggttagctatagagagaggagccccgcctcagtcttttctttaggggcagcaccttctattacagtctcgggaccccaaagcacgctatttgggtttggtagagaaaaccaggtgtaaaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttgg

SEQ ID NO: 10167 - DNA, 1333 bp, Homo sapiens
aaagtaacatgctgctttgcagttagctttttgcttagtttctagtatcagttttcatggaattttttcattgtctttacccactgatacatcagtgtactcttctgcttggtaccaaaaacggggatacaaaacgtggagaaaccctgggactgagccttgggttcctgccctctgtgccactaactccccgtgtatcccctcctcctctgcacctccagctcttcctctgtaaacgacaacctggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtg

SEQ ID NO: 10168 - DNA, 3038 bp, Homo sapiens
tttatagagggcatctgtcggttgcatttgatttatttaaaacgttttcttacatggccaatttagtaacagcaagcaaaaccaaaatgagcaaaggagaggatcccaataatcccagatctataaagcggatttctcaagggggtagagataaccacctagctattgctaaatgtgatctcactcagttgaaaaagaaacaatcagaagtgagcaatgggagccgtgaaaccatctcaatgaagacttgttgccaacatggagatagaggatattggtctacagggtactattggagagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccctgggacagttttgtatgctgtatcttgtacacaggttgtaggttggtttattgccattttgttttatttctgctgtataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagctt

SEQ ID NO: 10169 - DNA, 2263 bp, Homo sapiens
ctagcggctctccccgcgtccaagatggcggcagaagcagctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactca

SEQ ID NO: 10170 - DNA, 2632 bp, Homo sapiens
acttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgacctt

SEQ ID NO: 10171 - DNA, 7296 bp, Homo sapiens
aaggatcaaagttcctcatacacggtagcgtcgagccttttttcggttctttcgccgctcgttttattcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttatttggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatccatcctgaattttataaatgattttttatttaaaaatttgagatttttaaaatttttcacagcacaggtcttctcattttcttttttagcaaaaaatacttgactatataaacaagactagaaatttatcctaaacagatggtctttctctgagggaaaaaaaaaaatgtgtcatgtgaggcaatatgcattctttgtattctgattttttaagtgttttcatatttatagccatcacaaaattttgcccaaagtgtatggctcagaagagatgatcaataactaaaatgtttttcgttttgcacatggtaaaattttaggtagagagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcattgtttttctaaaattgagaaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgaccattccaggacaatttttggtcccattttgaggattgccatagttgcaagtccttaggatcttccttgttttaaaaaactatcaaagtaggttaaattaaaatctaatttaaattaggttaatttatattacattgtagatcattcttttttcccccctctttcacttctaaatattttgctttctaaatactagccttctggttcacagtgaaataatttaattatcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaattttgctgcataataaagataattatagttacatgtattgatttaagtctcacacactgtgctaataagtcctttgcacatattattggattctagagcaaccctaggatttgggtactattatttccatttgacagatgaaaaacctaatgcatagaaagataagtagaccagtcaaggtctacagctagtaaaatgctcagattgaaacctaaatcttttctcactcacttttaggttctatatgctattctccttacgtaacgttaaatagatcctttagtttgataggttcattagttttgcttaatcgttgcttccaatatgattcttattgtagtatttatattacaaagttggcatacagggtcaatatctaatttactgttgtgtttttcttaatatgttcaatgtatggtcatactttttaaatttgattttttaaatattataagtggtcatgaaattttaatgttaagtttgtacctaatagaaatatgtctatcacaaatctttattggtattattttatatacttttccagcttgataattttcacaatagaaagagaccaaatattttgtactatattttgtgacatagaagtaaatgacaactctaccttggaagatatgaagaaatcagtgtttttatgttcaaaaactattttaaatgtcataggcttgccaattgtgttaactatttagtacattggtagtttttaaatgactaatgctggagtgaaaatgtaaggcaaaatatttagtatattaacagtagatagtcattttcatgtaatcagaattgcatgttaagggttttaaaagctgtcataactcttaccttttatttctaccagtgatcaatcatttctctttacaaatttagggaggaaacaactgttcaaatgtataggggacagaaacctgacatttagagaacagaaattttaattgccaaattaaagcagctaggctgcccctgggcttaacaaaattcctatttttgaactagacccgaggtattttatcattattatttgataggtaccattaacctttgttttgtgattatcgacttttggggggaaagatgagtaattaaacacactcgcccattttctaagtggtttagaaggttgcagtctgcctcaccatacaaagccagtttaaataggaatatatcacatcatacttcacatagcagtcaacctcagaggaaagtcatttattcagaaggcatagattttgctagacagcagtgatgcattacaaatatataattatttgcactaatatttgagcaggtggaatggattagaacatggtcaacatcatgctgctgataacatgtatttttctatattaatatgtactgtgcaacatgtattaaaattgtcaataatt

SEQ ID NO: 10172 - DNA, 3564 bp, Homo sapiens
agcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacatgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaa

SEQ ID NO: 10173 - DNA, 2714 bp, Homo sapiens
gtcgttcccgcggcgccgcgcctcgctggctcctcagcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtgagttggtttttttcctattgttttaaataagaatttttttctattattgaaaggacagatacatttactataaatcatagtgaatcatgagttttgctttcttcattacactaacctttgtacttaaaatttgcgcatcaggataatccactaaagcaaatcttagccttttattaataaatcattgtcctttataaatgatatcaaggattggtaatgttgatcaagtacaaatagccgaacaggaatgaaaatattgattagcttaccaacatactaatattgcatgtaactaagggctaagtgcatattgtggaaggaaaagagtgtaggcagttatattttgacagtctgggtgaatgtagtagttcacattctgttttataactcaaatgcatatatgacagttgaaaaagaaagtaatttaaagtagtttattgattgccataggagcattggatatagtgatgtttaaaatattttaaagacgaacagttttggccaggtgtcatggctcatgcttgtaatcccggcactttgggagtctgaggcaaggggatcacttgaacccaggagtttgagaccagcgtgggcaatatagggagacctcatttcacctccccacccccttccccccaaaaaacaaaagaaaaaaaacaaatgattcaaaagtaacatagaaaaaccagaataaattagacaatttggactagggaaaaaatgatttcttcttggttagtaactacttaattatcagaacacatcttatacagacctatagtaaaagatgtgtgtatgtcctgcttcattgtgctacatgttgaatttcattaggctttaccagttaatacaatttagtagaatgattttttccctgtaataaacaagccaaaaactattctgaaagtcttattttctttcacgtatgtattaataatatattctctttttaaatcaatgttatatatcctcacattttaaagattcaaataattttcctacgcgtttgctgccaaaaaaaaaaaaaacagatatcacctttcctatttcccattcaccattccttctttataggagcaaaaacttttacctcttttaatggattattttggtatttatatttatgtctttaaataactaacttttaattattaccatattattttccagtttggggcattatcggtttttcagtaatataatctaatatttatactcacattttctcaactatccccaaaatgtcttacgtctttttccctccctgaaaacattgatttgtatgtgttcttttgtcccttttaatctagaacagtcctcctgttctttgtttttttcatggaagagtgcaggtcagttctcttgtagaccagggcattttggatttatctagttgtttcttcatgtttagattcaagttaaaaggttttggcaagagtatagcataagtgatacctcacattgcatgacatcaggaggcttataaagtcatgttgtccttaggttatgctaaatttgatcatttggttaaggggaagtctaccagatgtcttttgaaaaggtatatttttctctttgcaattaataagtaatatgtgggtcctgtttcctaacaggttttcacccagtagttttatcattcttgccttaatccgttattatattggatttacaagatgttgatttaaaaaattctattatttcttaaacatttattaactggctgttttatatataaagaagagctttttattccccaccaccaccttttttctttttttccgattatggctgtgaacttacgcatttttaaaataaatatattataatttattattgtcattattcattttgatgcacaaattgtttcaaatttaacaagagaaacttctcaagccaattcctgtgtctttgtctttgagtatttttgtgtttattgtatcgtaagatgttccaagctctcattgtgccttttttttttttttttgcctcagatctggaagcagccattctccagggtaccctagctccttttagtattaatggtatttagaaactaagatgtatgggttgggagcagtggctcacacctgtaatctcagcactttgggaggctaaggcaggtggatcgcttaagctcaagagtttgagaccagcctggcccgtatggtaaaaccccatctctactgaaaaaaaaaaaaaaa

SEQ ID NO: 10174 - DNA, 2841 bp, Homo sapiens
agcaggactgagaggagcagaagacagtggggtgggagtagagggagggtggggagagctgaggagcagagggaagcaactgggccaccaggacagaagaccttgaatctccaggctgagccggctgtaccggaagaggatgaatgtgctgtgtaggaggagcggggtcatgcagtgacactggaaaattaggggcctgtcgagcgatgttggaagaagaaacagatcaaacctatgagaatgtcctggctgagattcagtctttcgaactgcctgttgaagctactttaaggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgc

SEQ ID NO: 10175 - DNA, 3567 bp, Homo sapiens
cagctggaaaattaggggcctgtcgagcgatgttggaagaagaaacagatcaaacctatgagaatgtcctggctgagattcagtctttcgaactgcctgttgaagctactttaaggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacatgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgc

SEQ ID NO: 10176 - DNA, 3263 bp, Homo sapiens
tcctcagcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagggtgacgaggaaacatttgaaaactattatcgaaaacaaagaaagaaacaagcaagactggtattgcaaccccagtcgaatatgggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacatgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgc

SEQ ID NO: 10177 - DNA, 216 bp, Homo sapiens
gggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaa

SEQ ID NO: 10178 - DNA, 5918 bp, Homo sapiens
agggaggggtcggcctgcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaaaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcgacctgctgcagcctctgtgtcagtctggggtccagccccagctgaccctgcatttgtgcattcttcttcaaagagagcatatgtatttttttattaacccctgtgcagtattcacataacatttccctatagtaaaagaggcacaagaataagcaagtacatgagatgttgctaggctgggactcaggggaagttattactacactatctgtgttatcttagagatggtggtatcatcaattccacagtgatgaaccacctttcatccatggctctaaagcttaggtctggggcttaggaaccataaaaagtgggtatctggcgctgggaggtagagtgagtaagcaaaaggatactaaaatatgtcctgttcactcttggatgcccattcaccacatagatgaggctgattcttctcaatacaaggaaagggcatggcaaacattactatttagtacactaagggcagctctggagggtcatctcctcagtctgctgactttcactggcttgtgaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagacccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaattaggaaagtccatttttaactctaaagggaacttttttctctaaaacttacttgtaaagctactgatacagatgggccgcatggttaggggaaagctcctctgtgaaaagagcatgtttattcctcttgtacattttcctcttttaactgctattaaacaagaaagcctacatacctgtttcaaaagcca

SEQ ID NO: 10179 - DNA, 2154 bp, Homo sapiens
gagcctgagggaggggtcggcctgcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaaaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctgtaagtggcagttgctactttgtcctttatatataa

SEQ ID NO: 10180 - DNA, 10187 bp, Homo sapiens
attattggctgtgggatcaagttcgtgaaactggtcttgtacaggttgaaaaatgccttcctaacaggaggcgccaaggagcttaagtgtaactcacacacagtaaagaaaatgacgaaagttcctccggcgtttgatttcagtttcttaaatgacgaagaggccaggaagatccttcaggtgctggaaaggaatgaggagttacagagggccgagaaggacaggatcagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcaaattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaaggaaaaaaaaaagataaaggaattttgtaagtacttcctgttatatccgtagtggagcctgggaggcacatggtcaaagcacatgttgaggttatagattaggacctgaatccctagtaagccaatagaaggttagcagtcctagaaattcctctgaaaccgtgggggactggctggattattaagggcttttagtcaagccaaggacttaggccaggcaacctgaccatacagaaagttgcctggtcacagaatttctgcttatgaagagaacatagctgaggagcagaggtaggaagtaggtatcccttcatgggaccgacttacctttactgcagttctctcagcaactggcttttcccatttcctcagaactatccattttcacattttcttttttttgtttttgttttttgtttggttttgttttgtttttgttttttggagacggagttttgctctgtcacccaggctggagtgcagtggcatgatctgggctcactgcaacctccgcctcccgggttcaagcgattctcctgcctcagcctccagagtagctgggatcacaggcgcacccaggcgcacgctgccacgcccagctaatatttttgtattttagtagagacggggtttcaccgtgttgcccaggctggtctcgaactcctgagctcaggcaatccgcccacttcagcctcccagagtgctaggattacaggcatgagctaccatgcccagtctttttttgttttgttttgtttttgtttttgttttgaggtggagtcttgttcttgttgctcaggctagagtgcaatggcatgatctcagcttactgcaacctcctcctcccaagttcaggcaattctcctgcctcagcctcccaagtagctgggactacaggcacccaccaccacacctggctaatttttttttttttttttttttttttggtatttttagtagagttggagtttcaccaggttggccaggctggtctcaaacttctgacctcaggtgatctgcccacctcggcctcccaaactgctgggattacaggcatgagccaccgtgcctggcccacattttctttaattgcaaggtagaacgcttcttttcaggtggggcattttagtcccaaatatcaagtgggaaccttggccaagtccctaaaatgccatcaagtcagatctgacaccctggaattcattctttgctgcaggatcatctacgaaacccttgggaaattctaaggcagagctcctaagggcttgtcactatgattcagtgatttatctagagtaaatcacttatgatacccactgatattttggctttcctaactctttatttgccatgcagaacctcgggggatttctctcctaattcaggataaagaccaatagatggcagtgaagataatctgctttaactacagacagcatggattcctggatctcaatactatgatagtcaacatgagtggattttatcttgcttggtttatatttgcttcgcgacctaatctaattttccattttttatacctagtctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccatgcaactcaaagctaatgaacatgcggtaactaacatgaaagctattccctaaatctgtcaactattttaaacttcaagctctgaccaatcctgagctcagaaagctcaaaaatcaaatattgtgaacttttcaatgcaaatttgtatggtaaagaataaataacactatttcttggttaatatatgtttgtaaattctgcctttcctctttttctatttatctgattattattattattattattattttctttgagacagagtctcactctgttgcccaggctggagtgcaatggcgcaatctcggctcactgcaacctccgcctcccaggttcaagcgattctcctgcctcagcttcccgagtagctgggattacaggtgcccaccaccacgcccagctaatttttgtatttttagcagagacggggtttcgccatgttggccaggctggtttcgaactcctgacctcaggtgatccgcctgcctcagcctcccaaactgctgggattataggcatgagccacctcgccagccctatttatctgattatttaagtaaaactttaataaaccatgacctacattttctatgcaattttaagatactcagagttaatattttaatattgaggttcttgatttttttaatgatcagctttcaaattatatttcagtatatactctgagtctacgtgtatgctacaaaaggtgaaatgaagttagcttatttttcagtgagtttaggctatattaagagttaggtaagttaggtaagggtgaaactgctttggggcccagactgcgctggaatgtactgtttaaattcaaaggtaattgatggccagtgttcagttgctctatttgtaacgtttgcatgttggtctggctgaagtatcaggaaaacacaaaattcatgaaaatagcaccttttataattttatacttttataaagcacttgttaaagaagtatagcaaatttctatgtattttaacatacaagtcgctgcattttaatgttcatttttggtatagctatggtaacttataatagtcatttttatattcataacttgttttctgaaagatatagtcattattaaaataaacattcatgtaaatggagtaaatcataggggaatcaatcgtaataaataccttataaattataaacttgtttagatactagatttctataaccataaattttatactgtaaagtctgtttaaaatagggtttaatgaagttattttaatttttagagactcccctctaaataatttactcctacattgtaaatacattgatgccaacaaaattccaactgctactaacaaaggtttggttggtgataagctaataacagctactttgtgtaggaggtaaatatgtgtactggagggggtaaaaatccatttaggttatggcaaagatgggaatcaaactgtaaaactcatagccccataaaattaatattctttgttaagtgccagagggtttaagagaacttcttgcttagagtttattgataataataatgcttcagaatatcccatttaaatgtacagtgtaaatatgtaaaatattttacttcccaggcaagtttgtggctgtattgccacttagtggctctttgtgactggcagttctgtatatctgaaacaaataagctgtaagcacttttgttaaaactttgtcaaataatccttttatgtacttgttctcagacctgttctctggttatgaaatgtgttaaagacaaggtgcaaatttaaaacaatgcctgtattgaaataaatgacttaaacagatgca

SEQ ID NO: 10181 - DNA, 10142 bp, Homo sapiens
gataaagctactggtgcagccactgaaccacagggctttctcttccttcactctgcctctttctgattgggaacacacaacagttgttttaaagctttccctggagggtgagtgataagaaacctattacctggaagtatcgcctttctaaagtaggagaacaaaaggccacactttccccagatgcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcaaattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaaggaaaaaaaaaagataaaggaattttgtaagtacttcctgttatatccgtagtggagcctgggaggcacatggtcaaagcacatgttgaggttatagattaggacctgaatccctagtaagccaatagaaggttagcagtcctagaaattcctctgaaaccgtgggggactggctggattattaagggcttttagtcaagccaaggacttaggccaggcaacctgaccatacagaaagttgcctggtcacagaatttctgcttatgaagagaacatagctgaggagcagaggtaggaagtaggtatcccttcatgggaccgacttacctttactgcagttctctcagcaactggcttttcccatttcctcagaactatccattttcacattttcttttttttgtttttgttttttgtttggttttgttttgtttttgttttttggagacggagttttgctctgtcacccaggctggagtgcagtggcatgatctgggctcactgcaacctccgcctcccgggttcaagcgattctcctgcctcagcctccagagtagctgggatcacaggcgcacccaggcgcacgctgccacgcccagctaatatttttgtattttagtagagacggggtttcaccgtgttgcccaggctggtctcgaactcctgagctcaggcaatccgcccacttcagcctcccagagtgctaggattacaggcatgagctaccatgcccagtctttttttgttttgttttgtttttgtttttgttttgaggtggagtcttgttcttgttgctcaggctagagtgcaatggcatgatctcagcttactgcaacctcctcctcccaagttcaggcaattctcctgcctcagcctcccaagtagctgggactacaggcacccaccaccacacctggctaatttttttttttttttttttttttttggtatttttagtagagttggagtttcaccaggttggccaggctggtctcaaacttctgacctcaggtgatctgcccacctcggcctcccaaactgctgggattacaggcatgagccaccgtgcctggcccacattttctttaattgcaaggtagaacgcttcttttcaggtggggcattttagtcccaaatatcaagtgggaaccttggccaagtccctaaaatgccatcaagtcagatctgacaccctggaattcattctttgctgcaggatcatctacgaaacccttgggaaattctaaggcagagctcctaagggcttgtcactatgattcagtgatttatctagagtaaatcacttatgatacccactgatattttggctttcctaactctttatttgccatgcagaacctcgggggatttctctcctaattcaggataaagaccaatagatggcagtgaagataatctgctttaactacagacagcatggattcctggatctcaatactatgatagtcaacatgagtggattttatcttgcttggtttatatttgcttcgcgacctaatctaattttccattttttatacctagtctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccatgcaactcaaagctaatgaacatgcggtaactaacatgaaagctattccctaaatctgtcaactattttaaacttcaagctctgaccaatcctgagctcagaaagctcaaaaatcaaatattgtgaacttttcaatgcaaatttgtatggtaaagaataaataacactatttcttggttaatatatgtttgtaaattctgcctttcctctttttctatttatctgattattattattattattattattttctttgagacagagtctcactctgttgcccaggctggagtgcaatggcgcaatctcggctcactgcaacctccgcctcccaggttcaagcgattctcctgcctcagcttcccgagtagctgggattacaggtgcccaccaccacgcccagctaatttttgtatttttagcagagacggggtttcgccatgttggccaggctggtttcgaactcctgacctcaggtgatccgcctgcctcagcctcccaaactgctgggattataggcatgagccacctcgccagccctatttatctgattatttaagtaaaactttaataaaccatgacctacattttctatgcaattttaagatactcagagttaatattttaatattgaggttcttgatttttttaatgatcagctttcaaattatatttcagtatatactctgagtctacgtgtatgctacaaaaggtgaaatgaagttagcttatttttcagtgagtttaggctatattaagagttaggtaagttaggtaagggtgaaactgctttggggcccagactgcgctggaatgtactgtttaaattcaaaggtaattgatggccagtgttcagttgctctatttgtaacgtttgcatgttggtctggctgaagtatcaggaaaacacaaaattcatgaaaatagcaccttttataattttatacttttataaagcacttgttaaagaagtatagcaaatttctatgtattttaacatacaagtcgctgcattttaatgttcatttttggtatagctatggtaacttataatagtcatttttatattcataacttgttttctgaaagatatagtcattattaaaataaacattcatgtaaatggagtaaatcataggggaatcaatcgtaataaataccttataaattataaacttgtttagatactagatttctataaccataaattttatactgtaaagtctgtttaaaatagggtttaatgaagttattttaatttttagagactcccctctaaataatttactcctacattgtaaatacattgatgccaacaaaattccaactgctactaacaaaggtttggttggtgataagctaataacagctactttgtgtaggaggtaaatatgtgtactggagggggtaaaaatccatttaggttatggcaaagatgggaatcaaactgtaaaactcatagccccataaaattaatattctttgttaagtgccagagggtttaagagaacttcttgcttagagtttattgataataataatgcttcagaatatcccatttaaatgtacagtgtaaatatgtaaaatattttacttcccaggcaagtttgtggctgtattgccacttagtggctctttgtgactggcagttctgtatatctgaaacaaataagctgtaagcacttttgttaaaactttgtcaaataatccttttatgtacttgttctcagacctgttctctggttatgaaatgtgttaaagacaaggtgcaaatttaaaacaatgcctgtattgaaataaatgacttaaacagatgc

SEQ ID NO: 10182 - DNA, 2758 bp, Homo sapiens
cactgtcgctgagaaacaagaggcagcaagcagctggtgggttgtgtgatgaggctgctggatttaacagaccactgtcctcccctcttgggtgaatggagggtttttcacttccagctttcacccgaggctgtttttgtctgatgaaagaaagagcagaccacaatgtagatttatgtgactgtagctaccagagtcactagcaaggaaatactcttcaaatagatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcaaattgtgacacagacacaaccacagatgatgaatactacctggatgaaaatgacaaagagtcagaactgtgaggctttttcaataaaatgctttacttttttcaccaaaagcttataatg

SEQ ID NO: 10183 - DNA, 9828 bp, Homo sapiens
aaataaaaggtgttggaggtcactgtcgctgagaaacaagaggcagcaagcagctggtgggttgtgtgatgaggctgctggatttaacagaccactgtcctcccctcttgggtgaatggagggtttttcacttccagctttcacccgaggctgtttttgtctgatgaaagaaagagcagaccacaatgtagatttatgtgactgtagctaccagagtcactagcaaggaaatactcttcaaatagcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcaaattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaaggaaaaaaaaaagataaaggaattttgtaagtacttcctgttatatccgtagtggagcctgggaggcacatggtcaaagcacatgttgaggttatagattaggacctgaatccctagtaagccaatagaaggttagcagtcctagaaattcctctgaaaccgtgggggactggctggattattaagggcttttagtcaagccaaggacttaggccaggcaacctgaccatacagaaagttgcctggtcacagaatttctgcttatgaagagaacatagctgaggagcagaggtaggaagtaggtatcccttcatgggaccgacttacctttactgcagttctctcagcaactggcttttcccatttcctcagaactatccattttcacattttcttttttttgtttttgttttttgtttggttttgttttgtttttgttttttggagacggagttttgctctgtcacccaggctggagtgcagtggcatgatctgggctcactgcaacctccgcctcccgggttcaagcgattctcctgcctcagcctccagagtagctgggatcacaggcgcacccaggcgcacgctgccacgcccagctaatatttttgtattttagtagagacggggtttcaccgtgttgcccaggctggtctcgaactcctgagctcaggcaatccgcccacttcagcctcccagagtgctaggattacaggcatgagctaccatgcccagtctttttttgttttgttttgtttttgtttttgttttgaggtggagtcttgttcttgttgctcaggctagagtgcaatggcatgatctcagcttactgcaacctcctcctcccaagttcaggcaattctcctgcctcagcctcccaagtagctgggactacaggcacccaccaccacacctggctaatttttttttttttttttttttttttggtatttttagtagagttggagtttcaccaggttggccaggctggtctcaaacttctgacctcaggtgatctgcccacctcggcctcccaaactgctgggattacaggcatgagccaccgtgcctggcccacattttctttaattgcaaggtagaacgcttcttttcaggtggggcattttagtcccaaatatcaagtgggaaccttggccaagtccctaaaatgccatcaagtcagatctgacaccctggaattcattctttgctgcaggatcatctacgaaacccttgggaaattctaaggcagagctcctaagggcttgtcactatgattcagtgatttatctagagtaaatcacttatgatacccactgatattttggctttcctaactctttatttgccatgcagaacctcgggggatttctctcctaattcaggataaagaccaatagatggcagtgaagataatctgctttaactacagacagcatggattcctggatctcaatactatgatagtcaacatgagtggattttatcttgcttggtttatatttgcttcgcgacctaatctaattttccattttttatacctagtctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccatgcaactcaaagctaatgaacatgcggtaactaacatgaaagctattccctaaatctgtcaactattttaaacttcaagctctgaccaatcctgagctcagaaagctcaaaaatcaaatattgtgaacttttcaatgcaaatttgtatggtaaagaataaataacactatttcttggttaatatatgtttgtaaattctgcctttcctctttttctatttatctgattattattattattattattattttctttgagacagagtctcactctgttgcccaggctggagtgcaatggcgcaatctcggctcactgcaacctccgcctcccaggttcaagcgattctcctgcctcagcttcccgagtagctgggattacaggtgcccaccaccacgcccagctaatttttgtatttttagcagagacggggtttcgccatgttggccaggctggtttcgaactcctgacctcaggtgatccgcctgcctcagcctcccaaactgctgggattataggcatgagccacctcgccagccctatttatctgattatttaagtaaaactttaataaaccatgacctacattttctatgcaattttaagatactcagagttaatattttaatattgaggttcttgatttttttaatgatcagctttcaaattatatttcagtatatactctgagtctacgtgtatgctacaaaaggtgaaatgaagttagcttatttttcagtgagtttaggctatattaagagttaggtaagttaggtaagggtgaaactgctttggggcccagactgcgctggaatgtactgtttaaattcaaaggtaattgatggccagtgttcagttgctctatttgtaacgtttgcatgttggtctggctgaagtatcaggaaaacacaaaattcatgaaaatagcaccttttataattttatacttttataaagcacttgttaaagaagtatagcaaatttctatgtattttaacatacaagtcgctgcattttaatgttcatttttggtatagctatggtaacttataatagtcatttttatattcataacttgttttctgaaagatatagtcattattaaaataaacattcatgtaaatggagtaaatcataggggaatcaatcgtaataaataccttataaattataaacttgtttagatactagatttctataaccataaattttatactgtaaagtctgtttaaaatagggtttaatgaagttattttaatttttagagactcccctctaaataatttactcctacattgtaaatacattgatgccaacaaaattccaactgctactaacaaaggtttggttggtgataagctaataacagctactttgtgtaggaggtaaatatgtgtactggagggggtaaaaatccatttaggttatggcaaagatgggaatcaaactgtaaaactcatagccccataaaattaatattctttgttaagtgccagagggtttaagagaacttcttgcttagagtttattgataataataatgcttcagaatatcccatttaaatgtacagtgtaaatatgtaaaatattttacttcccaggcaagtttgtggctgtattgccacttagtggctctttgtgactggcagttctgtatatctgaaacaaataagctgtaagcacttttgttaaaactttgtcaaataatccttttatgtacttgttctcagacctgttctctggttatgaaatgtgttaaagacaaggtgcaaatttaaaacaatgcctgtattgaaataaatgacttaaacagatgc

SEQ ID NO: 10184 - DNA, 6542 bp, Homo sapiens
gaaacatgtcattaagtttcttaaatgacgaagaggccaggaagatccttcaggtgctggaaaggaatgaggagttacagagggccgagaaggacaggatcagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcaaattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaagg

SEQ ID NO: 10185 - DNA, 2721 bp, Homo sapiens
gacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagccggtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgatcagcaaccgctggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 10186 - DNA, 2808 bp, Homo sapiens
gtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagccggtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgctggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 10187 - DNA, 3334 bp, Homo sapiens
gaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagccggtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgaggtagagtgtcggatctgttttctcccccaggagggaaaacgtcaagtcacagccagtgcaagtacacctctgacagaggcctgtgctgacagctggcagaaagctactgccggcttgcacgttttacatgccagcctgctggtgtcttttaatgcagagattggagaatgttctctttggacctcacgactgctcccatgcccctccggatggctatccaatcatcccaaccagtggtaaagtcgagagccctcctgactgtcccgaagaggttgggacacagctaccttgtctaaaattctgtaggcttggccgggcgtggtggcttatgcctgtaatgccagcatattggaaggctgaggcgggtagatcacctgaggtcaggagtttgagaccagcctggccaacatggtgaaaccccatctctactaaaaatacaaaaattagctggcatggtggtgggcacctgtaatcttagctacttaggaggcagaggcaggagaatcacttgaaccgaggaggcggaggttgcagtgagccgagattgtgccattgtactccagcctaggggactacactaaaactccatctcaaaaagaaaaaataaacaaaattctgtaggctttgaccttactatcttctgctcctctaggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgctggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaag

SEQ ID NO: 10188 - DNA, 872 bp, Homo sapiens
gcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctg

SEQ ID NO: 10189 - DNA, 1198 bp, Homo sapiens
agtcacagcaccagctcttttataaagagggagacccgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcggcgcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaa

SEQ ID NO: 10190 - DNA, 1481 bp, Homo sapiens
gatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattcca

SEQ ID NO: 10191 - DNA, 1529 bp, Homo sapiens
gacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagagctggggtttcaccatgttggccagactggactcgagttcctgacctcagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattcca

SEQ ID NO: 10192 - DNA, 4015 bp, Homo sapiens
ccgactggagagggatgggaggagataccatagggtttggggggcttggcacagcggccctggcctctgcactgtgatagctccaagccagatggtgcaaggcagctgctgggctgcggggaagaggggctgcacttcctgagctggtgcagcggcagagtggataaggatcaggaccccgagccctcctggccctccaaggcagggggacaccggctgcacccaggctgtgacctcagctgacgccgatgatccacatgggatgcagggtctaattttagctccagccacaggggccacagcccagaagcgtctgccagcgggcacaggggcagccagggctgctcaggcaaggggaggagtgggaagaccagcccagctccctccagcctgtccctggccaagccgcctcctgtgggagctctgactggtccccatggcctggcagacagccctcctctcagttgagggcaaggtcaaggggtgcagccaggagggcagggggacacggccctgcattctggacaggggttgcgtcagccagagcagtgcccaggggcaggggtccctgctgggagggaaaaggctggcttggttgtccaaaggccgagaaggcagagtcctgagagcaggggggccaggccagcaagctgggtcccacctggcctcctcctgcctggctggtgactcactatctgaccttagacaggcggcctggtctcgatgggcctcagtcttcccatctgtacaatgacagcacaggactagcaggtcggtcccagctctggtctcccgccccaggccctgctcttcctgcttgctggcagaggcctcccagcttccctagccctgactgtgggtggccacatgcagtcgtggaggagaagaaagtccctgtggctggcactgtcagcctcctggctcctgcttgtcctgctgggaggcttctcccttctccgcctggcattgcctcccagacctcggcccggggcttcccaaggctggccccgctggctggatgcagagctcctgcagagcttctcccagcctggagagctcccagaagatgccgtttcacctcctcaagcccctcatggtggcagctgcaactgggaatcttgctttgatacctcaaagtgcaggggcgatggccttaaggtattcgtgtacccagcggttggaaccatctctgagactcatcgcaggatcctggcttccattgagggctctcgcttctacacattcagccctgctggggcctgcctcctcctcctcctcagcctggacgcccagactggagagtgcagctcaatgcctctgcaatggaacaggggcaggaaccatctggtcctccgtctccacccggctccctgccccaggaccttccagctgggacaggctatggtggctgaggccagccccacggtggactccttccggcccggctttgatgtggccctcccttttctccctgaagcccacccgttgcgaggtggggctcctggccagctgcggcaacacagcccccagcccggggtagccctgctagccctggaagaggagaggggtgggtggcgcacagcagacactggctcctctgcctgcccctgggatgggcgctgtgagcaagaccctggacctgggcagacccagcgccaggagacgctgcccaatgccaccttctgcctcatctctggccaccgtcccgaggctgcctcgcgcttcctccaagccctgcaggccggctgcatcccagtgcttctcagcccccgctgggagctgcccttctccgaggtcatcgactggaccaaggcagccatcgtagctgatgagaggctcccacttcaggtcctggctgccctccaggagatgtcccctgcacgggtcctcgccctgcgtcagcagacccagtttctatgggatgcctacttctcctcagtggagaaggtcatccataccactctggaggttattcaggaccggatttttggaacatcagctcacccctcactgctgtggaacagccccccaggggcactcctggccctgtctactttttccacaagcccccaggacttccccttctactacctgcaacagggctcccgccctgagggcagattcagcgccctgatctgggtggggcccccaggccagccccctctgaagctcatccaggcggtggcaggctcccagcactgtgcccagatcttggttctctggagcaatgagaggccactcccatccaggtggccggagacagctgtgcccttgacagtcattgatgggcacaggaaggttagtgatcgcttctacccatatagcaccatcagaacagatgccatcctcagcctcgatgcccgcagcagtctttccacaagtgaggtggactttgcctttctggtgtggcagagcttcccagagcggatggtgggcttcctgacgtcgagccatttctgggacgaggcccatggtggctggggctacactgctgagaggaccaacgaattctccatggttctcaccacagccgccttctaccataggtattaccacactctcttcacccactccctgcccaaggctctgaggaccctggcagatgaggcacccacctgtgtggacgtcctgatgaatttcatagtagcagcagtcaccaagctgccccctatcaaggtgccctatggcaagcagcgccaggaggctgctccactggcgcctgggggcccggggcccaggccaaagccgcctgccccagcccccgactgcatcaaccagatagcggcagcgttcggccacatgcccttgctgtcctctcgtctgcgtctggacccggtgctgtttaaggacccggtgtccgtgcagcgcaagaagtaccgcagcctggagaagccctaggggggcgacccgcggagaccccagcagaggtcgcagcccagctcccagggggcccggcgcctgccggcgggctccgctcttgggacaccggagaacctatcatgtcagccagcgggcccacacgtcggaccccggttggccaatcacaacaggggggcgtggccttaccttctcctgctcgccctcagccgcggagcctctgcggaggctgagccccgcgaccggagcgccgctctccgcttctccacccagctaacttctgctcgtctttcagagcattgtctcctccagggacttgcctggccctcctccccctccgcccccaatgggttcggtctcctttgcgctttcgcagtccagtgtttgccgcggttcccgcacggtcaggccccaggactggcttgcgagccccggggggcgggtcgtgtcgtgtccttttctctctggctaggcaggtgtgccgcaaatatttgacgaatagatggatggcagacattaactgcgtgcctggccctatgagggcggcggcgggacagggtgagcggagagacagaactgtccccgccccaccccgccacccattcctagggttcctagtcccgggaaggcaactacccaaagacgcctgggttgtcaggctcaatccttgagcctcaaccaaggagcagaggggtgcgggtaaacgaggagtggggcgaggaaagcgggatgggaacaagtggcctgtccccgcacggcccgcggctcagcctcggccgtctgccctgcactaccaaggccgaccactagaggtcagcgtcgcgccgcactcttcacccgcatgtccagagggcggccgggatgtggagggtgagcgctgtgggcagctcgggggctgaaagctgggaagagaaatctgaagaacagccccatctctttcgcctgcacacttggaactcagcaagaagggactgtttctaggtgggctgggcgcgagcagggactgtcccgagcggtataggtgagaatggagttggggggggacactaggtcctccggggttcacccacctggagctggaattatcacttccgaaataaagcgcgtgtccttgccccctcacgctccaggctataaa

SEQ ID NO: 10193 - DNA, 2835 bp, Homo sapiens
cactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcca

SEQ ID NO: 10194 - DNA, 3985 bp, Homo sapiens
gggcgggatgagaaaggtgctggagctgttggagggacgccaggaggtggcaactaccagggggtgtgaggggctgacctgggatggaatcctgccacccggactcaggaagaaaatcctgaggtggcgacctgcagactgggctgggagatggagagcccgctcacgcccacccgaccgcctaccaccagtgttcccggatgcatgggctccagcgcctgccctttcgccatttcctcccaactggcattaaatcctggtgtggtagatatcagtgattaagagtctaggcagccacgtgttctattgccgccagtccgcaggaaacgcaagtgatcgttttgctgcgttaactctatgggcgcccaaatcttaggaatccattccacgccaccccgaaaacagcgcttgacccttctggactgccacgcaggaggcgatcaatgtttttctttctttatttttttaagagacaaggtctcgccctgtcacctaggctggagcacaatgaggctcactacagcctggaactcccggacgcaagtgatcctcctcagcctccggagtagctgagacctcaggcgtgcgccaccatgcctggcatcaatcaatgtctttcaaaataaaggctgttaaacgtagtataggaaagaagctttttaatggtaggttctaccagacgtgtttgtttgatttttaggtttggttaatgcattgtttcccgtacaatctcaacccgcggaaaccccgaaactctagaattcgtgccggtctctttcgcttccaggtcatccccggggcaacggccgccgctctaattcttgtcagaacctccaggccagtttcagcaacgtgcaggcagaagctggcccctcggtgggatgcgagggcgtgtggagcgcggggaggagagccccacaggcctttcctgggcacccgcggtggatgggaaggctccttcgggcgcctttcagggaagttgtttggctgagggaaggtggtccgtcacgtgaatgtttaaaagttgttaccttggagaagaaatggaggaaaggattggctttcggaggtgggctggaaactacaaaaccgagcttcctgggaatgccttttaggccgacaggaagtggagcgtcaccgaaagggaggggcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcca

SEQ ID NO: 10195 - DNA, 730 bp, Homo sapiens
actttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgagaacctggaacagtggtggcacaaagtaagtgctcaggaactatctgttgaatgagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacagg

SEQ ID NO: 10196 - DNA, 902 bp, Homo sapiens
ggctggccctactgcaatctactgcactcgagtgacaagtgagcctgcttctgtcaattactgaagctataaggagattttttaaaaattaaacttcaacacaatgagaacctggaacagtggtggcacaaagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaaga

SEQ ID NO: 10197 - DNA, 1780 bp, Homo sapiens
gtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgaggtaaaattgggggattaggagctatctgaaaggaaatgtctgtgatggatacaggggataaactcctacttaaaagaatacatgagaaggaagcagtcactcatgagtgtcttcaacggtgtatatttatagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgtttt

SEQ ID NO: 10198 - DNA, 6483 bp, Homo sapiens
acaatccccggcgcccggccccgcgcccctgacccgggtgtcaccgcggagctgcgggaggcctcggcggtcttcggacgcggtcgggaaagtggcgagcgcgcgcccgcgtccgcgcccccgctcgcgaacgccggcttcggccatttccggcgcggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 10199 - DNA, 1779 bp, Homo sapiens
agagggcggggccgggccgctggcgctgtcgccggctgcagtggccgccgctggagaccgcgggacctggcgctgcagcgaggagagcaagccctggaggttcactctttcaagaagtcgtgtgctgaggtgtaatgctacacaagtcagaggaaggaagggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagg

SEQ ID NO: 10200 - DNA, 4915 bp, Homo sapiens
caaccggttccgagtttgaggcactaggaggagggggagaagcggctgcagcggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggggccagcgccggagccgcgtgagagagggagccgtgttttggtaggggggagtcggactgcaactggcagcagagcgtctccccggccgtgtggactctacaccccctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtgtgtgtgtgtgttgggggaagcgtccctgaaatagtaaatattattgagctctttttgcccttttcctgtccgtttttttaatttccttttttgaggtgggaaaactgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagtt

SEQ ID NO: 10201 - DNA, 4105 bp, Homo sapiens
agcttgggatgggggagggaggggctgccgactccctgttcctccagcaaggaaactcgaaagctctccggttttgcagagtggcatgtgaagtaggaaagatcagtttttcaggggcctgcacatgggattccgtcttgtagttccttttcaggggtttgaatgtgataagttggttaaaccatttactgttggccttgtacagtggaggatgccctgattctccttcattccgatgtctgtgagtttgggttgggtgggaggaagtggtgtagtagaggaagcattcagtactggctcagcccggacctcctctgatcacgccgaggccatgctgcatagagaaaggggcggtgaacttaaggcgcctggtctaaatgcctcctccgagtaagggcgggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactg

SEQ ID NO: 10202 - DNA, 3479 bp, Homo sapiens
ggagaagcggctgcagcggccgcggcaggagcagcgggagctacagcatcagcaagagcaacagtagctacagccccggcggcggtgcctgttccagtctttgctgctgcagaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggcccttt

SEQ ID NO: 10203 - DNA, 682 bp, Homo sapiens
acttgcttaaaaagttttgacatcaagatactgaactgtatcacgttttaggaccataaaatcctaatagtggatgcgtttaaataataggttagcatactttataaatgttagtagaataggaaagtcttcctggtgtataaactaaacactagaaaagttgaatggaccataataatttatgtaattatcaaatagctaagtaatttcagcttttgttacttgcttttactatctcagttttctgtaattaaagtctctaaagtattcattaaaatatttgtaataacatggttgaagtaaaataacttgtaggaagtttttgataataccaaaacttgataggcagcttcaattttttttctttattttcagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaag

SEQ ID NO: 10204 - DNA, 382 bp, Homo sapiens
cggggttttgccatgttggccaggctggtctggaactcctgacctcaagtgattcgcccacctcggcctcccaaagtgctgggattacagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaa

SEQ ID NO: 10205 - DNA, 318 bp, Homo sapiens
ggctttccttcgctctcttttctactcatccctgctcttcgtcccacctcctcctcctccacccctctcctcttgcctttcgaccctccccacttcccctcccccactctgcgggcaaatcgctgctgaaaagagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgct

SEQ ID NO: 10206 - DNA, 565 bp, Homo sapiens
ggctttccttcgctctcttttctactcatccctgctcttcgtcccacctcctcctcctccacccctctcctcttgcctttcgaccctccccacttcccctcccccactctgcgggcaaatcgctgctgaaaagaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgat

SEQ ID NO: 10207 - DNA, 579 bp, Homo sapiens
acaacctaaggagcagtctttcgccttgtagcgacttgtttttcacctagtgtgaagttattaagcaacggttatgattttctgggttttgtttaggaattggcattgggtgtcacttgtagagtcacattatccattaagctggataatccctagtgtatgttatccagtgagtggattttaggattgaagagcccaatgggaatgagcgttcgtggttacacctctcgcactatggcttgtttgctgtctgattgtatatcttaagtgtgggacactgctgttagtggaaagaatgttttggaagcggtttgatttgggggactaaatgtgcttggcattgaccacaaagccgccatttctgtactatgtacagttcaggaatagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaaga

SEQ ID NO: 10208 - DNA, 643 bp, Homo sapiens
ggtggagagcttgggatgggggagggaggggctgccgactccctgttcctccagcaaggaaactcgaaagctctccggttttgcagagtggcatgtgaataatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttg

SEQ ID NO: 10209 - DNA, 488 bp, Homo sapiens
gtcccctctcccccctccccaccttccctcgccctaatcccccaacgaggaaggaaggagcagttggttcaatctctggatggagtctcattctcttgcccaggctagagtgtggtggtgcatctcggcttactgcaaactccgtctcctgggttcaagcagttctcctgcctcagcttcccaagtagctgggattacagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattctt

SEQ ID NO: 10210 - DNA, 5360 bp, Homo sapiens
acttccgcgggcgcgtgcgcagtggcgggccgggcgcgtgcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgtgtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggaagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacagaaa

SEQ ID NO: 10211 - DNA, 2070 bp, Homo sapiens
cgcgtgcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaagccacctcactttccaccactgtcagcctggaaagagatccaggtctggagctggagagaacaggccctgtgcaggaccagaagtaattatactaaagtatcaagaaagggagttagggcttaa

SEQ ID NO: 10212 - DNA, 3757 bp, Homo sapiens
acttccgcgggcgcgtgcgcagtggcgggccgggcgcgtgcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcatatcctttcaaaacctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctttgtagccgatctctag

SEQ ID NO: 10213 - DNA, 3307 bp, Homo sapiens
acttccgcgggcgcgtgcgcagtggcgggccgggcgcgtgcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcatatcctttcaaaacctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctggtgtccatccagtccactgacaagagggtttccccgagagccgaagtggactga

SEQ ID NO: 10214 - DNA, 3172 bp, Homo sapiens
gtgcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgtgtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatcctt

SEQ ID NO: 10215 - DNA, 4422 bp, Homo sapiens
ggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcc

SEQ ID NO: 10216 - DNA, 4255 bp, Homo sapiens
gaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggtagctcatgtaagtggagtcatgaagtatttggcctgttgtgactgccttatttcacatggcacagtgttctcaagcttcatccgtgtggtggcgtgtgtcagagcttccttccttttgaaagctgaattccattgcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctag

SEQ ID NO: 10217 - DNA, 4861 bp, Homo sapiens
gcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactga

SEQ ID NO: 10218 - DNA, 4818 bp, Homo sapiens
ggaaccaaagtaagagtttaaagtgcaacagaagagagtctgctgaactttagacatgagggatccagggaggaagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 10219 - DNA, 4889 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagtaagtgctacagccttcctcattgaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 10220 - DNA, 6623 bp, Homo sapiens
ggttacattttggatcctcgcggagtactggtcaggcggttaagtcctgtacctaggaaagagggcgagctctggggcgctctccggtgtcatgaggagcttcaaaagagtcaactttgggactctgctaagcagccagaaggaggctgaagagttgctgcccgccttgaaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctg

SEQ ID NO: 10221 - DNA, 6447 bp, Homo sapiens
cggttaagtcctgtacctaggaaagagggcgagctctggggcggtaaggccggaagggactcgtgagcgtggctctccggtgtcatgaggagcttcaaaagagtcaactttgggactctgctaagcagccagaaggaggctgaagagttgctgcccgccttgaaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaa

SEQ ID NO: 10222 - DNA, 6662 bp, Homo sapiens
ggcggttaagtcctgtacctaggaaagagggcgagctctggggcgctctccggtgtcatgaggagcttcaaaagagtcaactttgggactctgctaagcagccagaaggaggctgaagagttgctgcccgccttgaaggtgggggtgctgcctggctcgggatacacctggctttccaaactgagctgttttgtgtttgccttttgaagagatggataagagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcattt

SEQ ID NO: 10223 - DNA, 1444 bp, Homo sapiens
acaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttgg

SEQ ID NO: 10224 - DNA, 2070 bp, Homo sapiens
agaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 10225 - DNA, 1925 bp, Homo sapiens
aattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtggaaaggagggaagaggccctcgcccccactcccagccctggctaggagaaagggtgggctgctcacacattcccccttctatagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttgg

SEQ ID NO: 10226 - DNA, 3253 bp, Homo sapiens
caaatacttttcaacattcccttctgtcctttctttgtttttaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactgtctcctattctctactcagtggtatagcattaaatgatagaaatgaattttctggtgattcttcagaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggcaattccatcgcctccatcccagatgaagcatttaatggattaccaaatttggaaaggcttgatctgagtaaaaataatatcacttcttcaggcataggtccaaaagcattcaagcttctgaagaagttaatgcgtttgaatatggatggaaataatttgatacagattccttcacaattgccatctacattagaagaacttaaagtcaatgagaacaatcttcaggctatcgatgaagaaagtttatcagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggaattatacctagaaaataaccaaattgaagaaataactgaaatttgtttcaatcataccagaaagatcaatgtcattgtactacgttataacaaaattgaagaaaataggattgctcctttagcctggataaatcaagaaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacggaacattcttccagaagaaatttgcaatgctgaagaggatgatgactcaaatctggaacatcttcatcttgaaaacaattatattaaaattagagaaataccatcttacacattttcatgcataagatcatactcaagtatcgttcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggtatagtctctaggagttttattaatagtaaaggtaaaatctctcagtttcctacctctagaaagaggccatctcactagaataggatattatgcatactgagctagaccagaagagtctggaacaaaataaacacagcctttataatcaacttgaatactggtgttagctgagaactctgtaagtccctttaaaaattatgtatcttttggttcaagattaagaagcataatgacaacaaaaaaagcaggcagaatttatgaataagtgttgtttattattaaaacaataatttgttaatttcttataaggtcctgtgctataattactggtataaatataactgaatattggggtagctttcatttcttccattaattacatgtgtaaaattaaaacactactgtaatgttaatttcctggttttgaaaatcatattatggttatgtacattgttaacattaaggaaagctggcagaagggtgtgcataaattctatactctttttgaaacttttctataattctaaaattattttttaaagttaaacagtatattaagattaccttcactattcctcactcaagattaagacattttttgaaaagcagtagagtttgcttaaaatacaaattaattattcttgactataaccttgtaaaggtaaatctaatgtataaatttttgaaaaattttgcaccactggtcatagcatctatctcctttgccttaatttactgaaatacatcattttattcggttcaattgaaataaagctatgtctttactatgtattggccctaccaaaatcatatattaaaattttctaacataatga

SEQ ID NO: 10227 - DNA, 1606 bp, Homo sapiens
caaatacttttcaacattcccttctgtcctttctttgtttttaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactggtacagagatttagctaagcaaaatatcagtgtgtgattaatctttaacttccatttgtttttgttactaattttagattaaaattatgatacattagtcagatctgagtacttaaaatattggcaaaatgctgattaacatagaaaatatctgggaaaatgtatggtaggggatataaataatagactgtggctttatagttctagctctatcagattcagtaaacttggatgagattacattccacatttgactctcagctttagagatatggtaacagaatttctacaacagatcctgaattcttattgcattaagggctctgctttggtctatatgtgcattatcccacttaatccagtgcaacgtgcctttatcatcttgaagccagggtaaacaaaggaagagtgatttgcatctaaagagaacaaagccccaaccctctggctatacccaaccactcaaaggcagcacaggaacccacatcactgcttggataatcccaggaaaatgcagaaaaagtgtagcctgaagcatgattttctcatgtggcacttctgtgtgcaggagatcacagcgcgggttttgttggctgctcatggaccccttctccaatgaggctcatacctgactgaatgaaggacccttgggagggaggcccagtctcctctgagaaaagcctaaccaacaccttatgaaaataagcaaataaatacttgttaaataattggctgggaagggatagggacatcttctcttgtctataaccaaggtagattgctcccatgcacacagatgatcacagggtaggtgtctacaaaagtctccttgccaggaaaaacttttgactatttagaaattgtgttttgcgttatactaccaaatatttcactaatatttaaaaagagttaggaaaaaagtgttcaatgaaatggattccttggagtgaaataaatacaaggtttacaaagtaa

SEQ ID NO: 10228 - DNA, 612 bp, Homo sapiens
tttgcagataaagaaactgaggccaaagtacacaactaatttgccagcgtaacagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctact

SEQ ID NO: 10229 - DNA, 1999 bp, Homo sapiens
aaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactgaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggcaattccatcgcctccatcccagatgaagcatttaatggattaccaaatttggaaaggcttgatctgagtaaaaataatatcacttcttcaggcataggtccaaaagcattcaagcttctgaagaagttaatgcgtttgaatatggatggaaataatttgatacagattccttcacaattgccatctacattagaagaacttaaagtcaatgagaacaatcttcaggctatcgatgaagaaagtttatcagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggaattatacctagaaaataaccaaattgaagaaataactgaaatttgtttcaatcataccagaaagatcaatgtcattgtactacgttataacaaaattgaagaaaataggattgctcctttagcctggataaatcaagaaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacgctgtgtttcagatgctgttctagagacagtgacaaacagatcagatgtggcctttcctctctggtag

SEQ ID NO: 10230 - DNA, 4326 bp, Homo sapiens
aaaccaataaggttaggacaagagaatagctgtggtttgcgttgcaaaaaccaaaaaaaaaaaaaaaaaaaaaaaaagaaagccccgaggctccatgggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 10231 - DNA, 3843 bp, Homo sapiens
atttggctgccttccccccctgacaaggggaggaggaggatagacctgcaggaggaaacaacagttgagacctcaacttaaagacaatatgcctttcactgctgcagtatcctcctttttctcttttggttaaaagagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgt

SEQ ID NO: 10232 - DNA, 3907 bp, Homo sapiens
gagacctcaacttaaagacaatatgcctttcactgctgcagtatcctcctttttctcttttggttaaaagagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 10233 - DNA, 3590 bp, Homo sapiens
atgcttatgatatatgttcagttagtagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 10234 - DNA, 1723 bp, Homo sapiens
atgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgaca

SEQ ID NO: 10235 - DNA, 1540 bp, Homo sapiens
gtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcag

SEQ ID NO: 10236 - DNA, 2702 bp, Homo sapiens
gcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 10237 - DNA, 2465 bp, Homo sapiens
gcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 10238 - DNA, 1540 bp, Homo sapiens
gtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcaaaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcag

SEQ ID NO: 10239 - DNA, 1729 bp, Homo sapiens
ctgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttgcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcaactctatttcttagacatggaggcattgggttgccagctagaaccaactgccctgatactcttcatccagttaagtggaaaccttagcaactataataaactatgagattggtaa

SEQ ID NO: 10240 - DNA, 2459 bp, Homo sapiens
aaactgctgagagagacttgcaatccagtcacataagtataataaagaaatattggtcctcatggaagaagagcaagatttaccagagcaaccatcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaacttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctgacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgaga

SEQ ID NO: 10241 - DNA, 6085 bp, Homo sapiens
aggtttctagtggaacgaggtgtggattgtgaggtgactctggccgcttacttccggttcctagcgatgcgcatccgggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcgtgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctata

SEQ ID NO: 10242 - DNA, 5990 bp, Homo sapiens
gcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcgtgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttct

SEQ ID NO: 10243 - DNA, 1831 bp, Homo sapiens
gatgcgcatccgggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttgcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaact

SEQ ID NO: 10244 - DNA, 1837 bp, Homo sapiens
agcgatgcgcatccgggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagttatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggag

SEQ ID NO: 10245 - DNA, 5692 bp, Homo sapiens
gcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggaggggaaaacatgactgttttaaacacagcagactggttgctgagttgcaacaccccctcttctgcaacaatgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggcaaggaaagctgttttgagcgtatagtgtccagatttggcactaacataacttatgttgtgattggagatggccgagatgaggagcatgccgctaaccagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccatggcaaaaatgataatatcatcagaaatggaaggcagttctcccagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgcaggttctcctcgtaacagacttgcatatgtttgttagtttctgcctgtattgtcactgcgcaacggatggcattcattacaagaagagcccatcatcgttgtgtttgcatggtttttttccttgtgtgtagcccatgttgggaacacgatacaggttctcctcttatttcctatgacacgatttcccttgtggaaatttaagactttaagaactagagtatttttatggtgtctgcacctgcagttctgtgtttaaaatgtcataatgtggatcctggagtcaggctactagtcagtgcccctagccagaggctggttcatgagttcatcaactgaggcctctgtggcttcaataaagtctacattttgctcacagatcacaacattcactgtggaaatatgatttcatttctttaggctacaaacctgtatttctttactgaatgctaaggccatgtttatattgggtagaaagatattgagatcccaattttgtacaagattgtgatttcattatctaaaccttaaacttaatcctttaaattttgtagcttttggctgcatctgccccaagtactattccaggcaaattaaagttggaatacctttaataatataaaaataatgatagtaaatcttatacttctgttggcccttagcttgaaaatagcagttaaaaaaatttaaatgttgccttgattatcagtacttaattatgttgtgcactaaaaccttaaatatttattactgtgaataaaaacaaattatctttactgtatagctggtttctttaaatgttgatagaattgtggcattacatctaaatttgtaagtcttttcatatcaaacaagcaaggctttttatgctgctaagtctgtgggtgcagaaagaaacaccccttggaagggcaaagagaagccggctggttgcatcaccccgtgcagtttctcacacacatctctttttctgattctgtgttcagaagaggctgccggcataaaacctaaatgcaaggttgacggagaacagcttgtctggcacaacaatggtgcaggcccacgagccagcatcacagcttggccatgggacgttgagtatgcacaaactagaactcttcccttcccaccttaggaatagaaaatcctcttcctttctaatctgaaaaacgaaaactgaacaaacacaaaaccaaccccttggcagttcccacctcctattgacatatggaatattgtgccttattgtaaaccagtttgaaaaatgttctgtaactaaagtgggttttcggctattatgtatacagcttggtatattactacgaaagataaccaccttgtgttgcaccttaaaaatatcaagaccatgtaatttccataacaaaataggtggcctggctatggtattatagcatacaattaggacactatgcccctgcaaaattttgtaaatcaaattcagaggcaaaaacatattttagaatcatacagtttgcacacgacaagtaggtaataactgtctctaaaaatgttttctccttagtccgcaatgagctaagattcagaatagtgtcaacagcatgctcctatatgaagttgttttttttaaagcacatttgtttatgacaagcctacattctcagtgaatatggcatttagtatttcttttgaaaacaaacttaagcatcatgagccaaagttgcactttgactcccaactacggtagcattatggacatctcacaatgtcaagggtttctgttatgtattagtaaagtatagattattggggcctacataatttaaaagaaatgtaaattaatattaaaagcttgtaaaaatatgtatatctttactatttctcaataaatacctttgcaattgttttcatttccttc

SEQ ID NO: 10246 - DNA, 4317 bp, Homo sapiens
gggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggagtgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccatggcaaaaatgataatatcatcagaaatggaaggcagttctcccagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgcaggttctcctcgtaacagacttgcatatgtttgttagtttctgcctgtattgtcactgcgcaacggatggcattcattacaagaagagcccatcatcgttgtgtttgcatggtttttttccttgtgtgtagcccatgttgggaacacgatacaggttctcctcttatttcctatgacacgatttcccttgtggaaatttaagactttaagaactagagtatttttatggtgtctgcacctgcagttctgtgtttaaaatgtcataatgtggatcctggagtcaggctactagtcagtgcccctagccagaggctggttcatgagttcatcaactgaggcctctgtggcttcaataaagtctacattttgctcacagatcacaacattcactgtggaaatatgatttcatttctttaggctacaaacctgtatttctttactgaatgctaaggccatgtttatattgggtagaaagatattgagatcccaattttgtacaagattgtgatttcattatctaaaccttaaacttaatcctttaaattttgtagcttttggctgcatctgccccaagtactattccaggcaaattaaagttggaatacctttaataatataaaaataatgatagtaaatcttatacttctgt

SEQ ID NO: 10247 - DNA, 5699 bp, Homo sapiens
ttccgcgcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggaggggaaaacatgactgttttaaacacagcagactggttgctgagttgcaacaccccctcttctgcaacaatgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccatggcaaaaatgataatatcatcagaaatggaaggcagttctcccagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgcaggttctcctcgtaacagacttgcatatgtttgttagtttctgcctgtattgtcactgcgcaacggatggcattcattacaagaagagcccatcatcgttgtgtttgcatggtttttttccttgtgtgtagcccatgttgggaacacgatacaggttctcctcttatttcctatgacacgatttcccttgtggaaatttaagactttaagaactagagtatttttatggtgtctgcacctgcagttctgtgtttaaaatgtcataatgtggatcctggagtcaggctactagtcagtgcccctagccagaggctggttcatgagttcatcaactgaggcctctgtggcttcaataaagtctacattttgctcacagatcacaacattcactgtggaaatatgatttcatttctttaggctacaaacctgtatttctttactgaatgctaaggccatgtttatattgggtagaaagatattgagatcccaattttgtacaagattgtgatttcattatctaaaccttaaacttaatcctttaaattttgtagcttttggctgcatctgccccaagtactattccaggcaaattaaagttggaatacctttaataatataaaaataatgatagtaaatcttatacttctgttggcccttagcttgaaaatagcagttaaaaaaatttaaatgttgccttgattatcagtacttaattatgttgtgcactaaaaccttaaatatttattactgtgaataaaaacaaattatctttactgtatagctggtttctttaaatgttgatagaattgtggcattacatctaaatttgtaagtcttttcatatcaaacaagcaaggctttttatgctgctaagtctgtgggtgcagaaagaaacaccccttggaagggcaaagagaagccggctggttgcatcaccccgtgcagtttctcacacacatctctttttctgattctgtgttcagaagaggctgccggcataaaacctaaatgcaaggttgacggagaacagcttgtctggcacaacaatggtgcaggcccacgagccagcatcacagcttggccatgggacgttgagtatgcacaaactagaactcttcccttcccaccttaggaatagaaaatcctcttcctttctaatctgaaaaacgaaaactgaacaaacacaaaaccaaccccttggcagttcccacctcctattgacatatggaatattgtgccttattgtaaaccagtttgaaaaatgttctgtaactaaagtgggttttcggctattatgtatacagcttggtatattactacgaaagataaccaccttgtgttgcaccttaaaaatatcaagaccatgtaatttccataacaaaataggtggcctggctatggtattatagcatacaattaggacactatgcccctgcaaaattttgtaaatcaaattcagaggcaaaaacatattttagaatcatacagtttgcacacgacaagtaggtaataactgtctctaaaaatgttttctccttagtccgcaatgagctaagattcagaatagtgtcaacagcatgctcctatatgaagttgttttttttaaagcacatttgtttatgacaagcctacattctcagtgaatatggcatttagtatttcttttgaaaacaaacttaagcatcatgagccaaagttgcactttgactcccaactacggtagcattatggacatctcacaatgtcaagggtttctgttatgtattagtaaagtatagattattggggcctacataatttaaaagaaatgtaaattaatattaaaagcttgtaaaaatatgtatatctttactatttctcaataaatacctttgcaattgttttcatttccttca

SEQ ID NO: 10248 - DNA, 9498 bp, Homo sapiens
atgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagcacttatcctcattgtgatcttggaaaagccaaaaccagcagaacggaaagtgaagaaggaggctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataa

SEQ ID NO: 10249 - DNA, 2312 bp, Homo sapiens
gatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccaggtatttatgtatcatttga

SEQ ID NO: 10250 - DNA, 10485 bp, Homo sapiens
gatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagcacttatcctcattgtgatcttggaaaagccaaaaccagcagaacggaaagtgaagaaggaggctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataagttaacactagagattttagtacacactatacataaatgcagttattttgatagttatttctttgatacattgcttacggggaatcaactgtttactatattacctgaaatagtctaaatgctaacatatctttttgataagattgtaaaatgtcactgaaggttctgattgtttttcctacatctaatttatctgtatatattttgattcatgttttaactccattagttcagtgcttattcacagaatgtgcttattcactttgcttattcactttttacctatccctaatgcttacattttaaaatcaacgtgtaaacacaattttaaaaatcaatgtgtaagctgaactttaaaatgtttaaaattcagttgggaatgaattagggataggtacaaataagaaaaaaatcaagttattaatcaaaggaaaaataaaaattatacaaagcaatgtaa

SEQ ID NO: 10251 - DNA, 10589 bp, Homo sapiens
agaaacaaagtgatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataagttaacactagagattttagtacacactatacataaatgcagttattttgatagttatttctttgatacattgcttacggggaatcaactgtttactatattacctgaaatagtctaaatgctaacatatctttttgataagattgtaaaatgtcactgaaggttctgattgtttttcctacatctaatttatctgtatatattttgattcatgttttaactccattagttcagtgcttattcacagaatgtgcttattcactttgcttattcactttttacctatccctaatgcttacattttaaaatcaacgtgtaaacacaattttaaaaatcaatgtgtaagctgaactttaaaatgtttaaaattcagttgggaatgaattagggataggtacaaataagaaaaaaatcaagttattaatcaaaggaaaaataaaaattatacaaagcaatgtaaccatattgtattacatggcttagctacaacttatttatatgattcaacaatgtaaaacttgaacatagatttaaaccaaaaattattgcatgaatgtagaaagagaaggtgagaggagaggagaacaggctggtaagagctaaatccttatctttt

SEQ ID NO: 10252 - DNA, 2168 bp, Homo sapiens
gtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccaggtatttatgtatcatttgagcagataatatcacatatcaaaaagttataattaaattgatagtcatcgaa

SEQ ID NO: 10253 - DNA, 5450 bp, Homo sapiens
agaaacaaagtgatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagaagaatcctcaacacggtgataccacaccaaattcagcaacatatagaaaggtttatacagcatgaccaggtgggatttatcgtaagaatataagtttgatttagtggcttaaaatcaattaatgtaatttaatgtatcaatagaataaataaagaagaaaatgcatgataatgtagatggagaaaaaaattgtattacagaatctcacaacactttatgaaacaaacactcaacaaataaagaataaaagggaacttccacaatctgataagagaagttaaaaaaaaataagaagaatgaagaaacataactaacattatactttacggtgaaaggctgaaagactggaattttaaatcaaaacaatgagataacactttacacccagcaattctacttctagtatatactcaaaaaattgaaaatatatgttctttacaaaaatttatatgtgaatgtttacagttttgttcgaaagagtcaaaaagttgaaacaacccaaatgaccatcaactgatgaatggatatataaaatttgttatatccatacaatgaaatgttattcagcaatagacaaagatgaattactgatatgtgcttcaatacgaataaacattgaaaacattttgataaggaaaagtagtaagccacaaaagacacatagaatagtgctcaacaaatacttgtttaatgaaacaatgattttcagaagcttttttatttactaagaaaattatccttcgttttgtgatgttatttccttttttctgattttgtgattctcttttgtttgccattattttttgatatccagagaatcttggataaattacaaaatttttgtaatttatcaacactttaatgagttcttgatattgtctcataattaatactaacaatggagcccaacaaatgttgcagatacaagtattttatataaaattaagtttctctatatcagttgcaatatctagaaattatatgtgtgataccacctgttataatgtcaaaagatatgcaaaatgtttagaattaaaaaaaagatgctctaattctccattaaaaagaccctctatataccactaagctcaatgaaaaagagaaaattatatatacactgaataaatggaaatataatgcatggagttaaatattaggccttaaattagctaaaatattaattcttcccaaattaattcacacatttaatgcaatagtaaaaatattgcaagttattttagaaactaattatcatgttatatatatttatgaataatattttctaaattatgaagtcatctttgaaaaggaagactaatggggtgggatctgatgaaccatatgacatgacagactacataacacatatgggtgcctttaaaggaaaaaaaataataatgggtcaacagagagctctgacaacaacccgagtatatacgggaactcaatatatgagaaatttggctataatctcatttgaacatacagggttctttagtaaatggtattgaggaaatggctcataataagaccttaaatgaaactggattacaaccttataccttatatagaagtagactctaaatgtgtatagggatctaaaagtttaaggtaaaatgacgatataaatgaaagaaatgtagaaaaatatctttgtgatttcgggatggagaaatttttcaattaaactcaatttataaggcaaaataatgatagtattataatgatagacactaataatgttgatgatgttaacggacacaaagttaatgaatagcgtataaacattttcttttaaagtgtattttaaatgggtgcagattaaaattcattatataaatgatgtattgcaaacaggtctgcatattaccacatttttttgccctgaaatcttcaaaaaatttttctgggggtttataaaatgtttaatgagccaaagactaaatcataccagccatattgttacttaagaccaggaaagatttgctaagtctgggatgttaatttcttaataccatgcccagactgtgaagtgttcatgactcccacctgtttttgaagcctcaaatttatgtctaagtcaccaatccctacttgctaccagaaatatcataacagaatgaaatatattcattcatacatttattatttattgaatctcctctaactggaagatatttttcaaaatgttatgacaatgagacatgatacctgtccccaggtaatgtactatacataggtaagattatacactcttcagaacacatctcatggttcttctgtttcatttagaaagtgaacacatttttaaagtactaaagtaattatttttttcactttctgaacatacaagttgcttgattatagcagtgtgtcttctggctttctttctggaagttttaaatttaacctgtttcctttacaggctattttaggagattcacattttctgtgtaatgttaaatatatccaaaacataattttcagttataagtaagagttctgtttcaaagtgtagaatctaaaagtccataagaaaatcaggtgaagtttcaaaaactatttctgtagagtcaggaggcttgtaaaaatagagctttatgtgaatatggcacaaaagtatagtataatttgaccaggattttcttaaattatttctgatcccaaaagtctaataattatttattctaagactattgtaatttctgccgtgatgtccgtgattttattaacaagttgaatagttggttttaggtttatttatttattttggctatactatgcaaacttttctgccttcaagtaaaagttttatgtgggtatatttttacctttaaagcaaaaaagatatcgaactgcatatgaaagtgtcatattgaatgtatttttgggttggggccagtcttgaaaccactagatcaagtgtctaaatctttttgtctaaggcacttacatacactgatatattttctctctttattatgctctagaaaaccaaataatcttggttcttaaatccttatagtaaaatgatatagaaatcattcatttaagcaattctagagtacatatcattgtattacccatacacataccaaaattattataacaaacttcattaaatgaagcatttttgaataataaa

SEQ ID NO: 10254 - DNA, 2160 bp, Homo sapiens
gccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 10255 - DNA, 1211 bp, Homo sapiens
cttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggaaattacctgatgttccaaaccccctccagatcctgtatatccgcagcatctcccctttccctgagctggaacagtttctacaggacactatcaagagagcaagctataccagagaatcagatagcaagccctccctcagaggccaagggagcagaagagccatggatgggccccttcccaggacagcaggggtagaagtgggaaagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 10256 - DNA, 1730 bp, Homo sapiens
gaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 10257 - DNA, 1111 bp, Homo sapiens
gactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtactaggggcctggaggtttgggctccaagagaagcttgacagagcccacgcccgacccctacttctgtttcttcctaaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 10258 - DNA, 1803 bp, Homo sapiens
gaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggtagggaccttatggaggaggggcattatgcccaaagccattggtggcaccccagatctcagtaatgcaggggctgttgggtgcttcctgcaaatccctgagagggcagaagatagcttctgttaattcattattcttccaataaatgttgattgagtaccta

SEQ ID NO: 10259 - DNA, 1839 bp, Homo sapiens
gggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgagggtaagggtattaggggaagggaatgggtaagggagtttttagggtgctgggatagggagggccaataggatcgcccaccctaccacatgcttgccctccaccctccctgctccagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 10260 - DNA, 2656 bp, Homo sapiens
aggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtactaggggcctggaggtttgggctccaagagaagcttgacagagcccacgcccgacccctacttctgtttcttcctaaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggtaatggggaagagggtttatcaccttcagtctcacgtgccccagcagtcactgcaccctagctcacctgcagtagtggggaggctagagcctggaacctggatgaaggggcctcatcatccaagggaggcagtgctatctgttcattcatccttttgaccaatatttattgagcccaaattcaatagcaggcattgcacttcctactgtggatagaatagtgacttagacttgtgctgtccaatatagccattaattatttatttatacttaaattttaattaattagaatgaaatacatatgactaaaaaccactgaattatatactttaaaaggatgaatttgatggtatgtggatacctcaatttttaaaattaagtacaattaaaaattcagttctggctgggcgcagtggctcacgcctgtaatcccagcactttgggaggccatggtgggcagatcacttgaggccaggagttcgagaccagcctggccaacatggcgaaaccctgtctctactaaaaatacaaaaaattagccaggcgtggtggcctgtagtcctagttactcgagaggctgaggcaggagaattgcttgaacccaggagacggaggttgcagtgagctgagatggcaccactgtactccagcctgggcaacagaacaagactctgtctc

SEQ ID NO: 10261 - DNA, 1238 bp, Homo sapiens
atgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggaaattacctgatgttccaaaccccctccagatcctgtatatccgcagcatctcccctttccctgagctggaacagtttctacaggacactatcaagagagcaagctataccagagaatcagatagcaagccctccctcagaggccaagggagcagaagagccatggatgggccccttcccaggacagcaggggtagaagtgggaaagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 10262 - DNA, 1970 bp, Homo sapiens
gcgcggagcagtgacggctgcgataatagcgaggcagcagtgcagctttcagagggtccgggctcagaggggttatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactcct

SEQ ID NO: 10263 - DNA, 1427 bp, Homo sapiens
agtgcagctttcagagggtccgggctcagaggggttatgattcggagggttctgccgcacggcatgggccggggcctcttgacccggaggccaggcacgcgcagaggaggcttttctctggtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggct

SEQ ID NO: 10264 - DNA, 1825 bp, Homo sapiens
gattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaaggggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccacca

SEQ ID NO: 10265 - DNA, 3933 bp, Homo sapiens
ggagcggctgggaggttcgcgcgtttctcagggttcggtcggaggcggggaggccggagctgcgggcgtagggacctggcggctcctgaagcgcacgcgggcgggcggcaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccaacaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaatgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcagaattccaaggacaatcccagcactctgggaggcccaggcaggtggatcacctgaggtcaggagtttgagaccagcctgaccaacatggagaaaccctatctctactaaaaatacaaaactagccaggcgtggtagcacatgtctataatcccagctactggagaggctgaggcaggagaatcacttaaacccgggaggcagaggttgcagtgagccgagattgcgccattgcactccagcctaggtaacaagagggaaactccatctcaaaaaataagttaattaaattaaattaaaataaaacatgcgctgggtacagttgcttacacctgtaatcccagcactttgggaggccaaagtgggccgatcacctgagctcaggaattcgagaccagcctggccaacatagcaaaaccttgtctctactaacggtaaaaaaaattagctgggcatggtggagcatgcctgtcatcccagctacttgggaagctgaggcaggagaattgcttgaacctgggaggtggaggttgcagtgagcagagaccgagccactgtactccagcctaggtgacaaagcaagacccacagtaaagcccccacaccccatctcaaaaaaataaaaaat

SEQ ID NO: 10266 - DNA, 2184 bp, Homo sapiens
tgacccagattgcagtgagagttcccgcaggccccgcctctttctgggcctcgtgtctcccagccgccgggccgggtgcgaggccttacccctctgatctgctgcaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccaacaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgg

SEQ ID NO: 10267 - DNA, 4967 bp, Homo sapiens
attggtccgggcgcgaggggcggagccgccgcggagcaagcgagccaagcgcggcctcattagaccacgggttgcagccggagcggctgggaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccaacaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaatgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcagaattccaaggacaatcccagcactctgggaggcccaggcaggtggatcacctgaggtcaggagtttgagaccagcctgaccaacatggagaaaccctatctctactaaaaatacaaaactagccaggcgtggtagcacatgtctataatcccagctactggagaggctgaggcaggagaatcacttaaacccgggaggcagaggttgcagtgagccgagattgcgccattgcactccagcctaggtaacaagagggaaactccatctcaaaaaataagttaattaaattaaattaaaataaaacatgcgctgggtacagttgcttacacctgtaatcccagcactttgggaggccaaagtgggccgatcacctgagctcaggaattcgagaccagcctggccaacatagcaaaaccttgtctctactaacggtaaaaaaaattagctgggcatggtggagcatgcctgtcatcccagctacttgggaagctgaggcaggagaattgcttgaacctgggaggtggaggttgcagtgagcagagaccgagccactgtactccagcctaggtgacaaagcaagacccacagtaaagcccccacaccccatctcaaaaaaataaaaaataaaaaagaacaaagtatgctacaacaaaagtgaaaagagaaaaagaattccaagaacccgggctttctggatccaaagctctttcatggggacgtcctcttcccctcttggcttggtccagactttttctttttctttttttttttttttgcaatggatttcgctcttgtcacccaggctggagtgcaatggcacgatgtcggctcactgcaacttctgcctcccgggtctaaacaattctcttccctcaacctcccaagtagctgggattacaagcgcctgccaccacgcccagctaatttttgtatttttagtagagacagggtttcaccacattggccaggctggtctcgaactcctgacctcaggtgatccacctgtcttggcctcctaaagtgttgggattacaggcatgagccaccacgctcggcccagtccagactttttaactacctggccccactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaa

SEQ ID NO: 10268 - DNA, 567 bp, Homo sapiens
attagaccacgggttgcagccggagcggctgggagggtggaggttactacaatcataagcggggagccggtgcccctgaggaaggagaccctgagggagataagatggaggggctcgggattccggggagccccaagtcccagcttgaaacggtggagtccgggcaaatgagctctgaggacggcttctgggcctggccgtgacccagattgcagtgagagttcccgcaggccccgcctctttctgggcctcgtgtctcccagccgccgggccgggtgcgaggccttacccctctgatctgctgcaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgg

SEQ ID NO: 10269 - DNA, 3352 bp, Homo sapiens
gctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatc

SEQ ID NO: 10270 - DNA, 4144 bp, Homo sapiens
ccgcgcggcgtgagctccccggacatcgcgtctcgggatgctgcaagccagcgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttcttt

SEQ ID NO: 10271 - DNA, 3367 bp, Homo sapiens
ctgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaa

SEQ ID NO: 10272 - DNA, 3465 bp, Homo sapiens
ctgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaa

SEQ ID NO: 10273 - DNA, 1432 bp, Homo sapiens
ttcccccggcggcgtctcctcgcccgcccctccggccgccgccgtaacttgaccctcagcggggtttgggacttggggccgcgtcaccgtcgcggaggcgcttcggctccggactacgctcctgctgtgcgctcgcggggccagcagtgctggctctgcagtaggaggcgcgggggcatggcgcagaggctgggcgagtgggcccgggggccctccgatgccaccgggctctaccgggctgtgctgctccggtcggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgtt

SEQ ID NO: 10274 - DNA, 2159 bp, Homo sapiens
gctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccaggtgggtgatgggcacccagcagggaccacgcatcctccagggctgtcctccagggaggagctctgctgtggccacagctagtaagagggaagaggatcagcagacagagcactggactaagagtccactcctggcctgagtcctccctctgccattcactttgctaggtccttagggcgagtggcttccctgaacctcagcttcctcactggcccagtgtactgcatgctgattctgatttcattcttataactgtcttgtgagccaggtggcattcccattttagagatggggaagctgaggcccagagggggtgagtgatttgaaccaggctgcacaaggagaactcagtctcatgctctgtgccccagctaccaggctgatagcaaaactcatccccaggttggttctgtttccccactgagtgggcccttggtccaaactccacaggttttcagagtaggaatccccctagctccacccacttcactctctgcttctccctccttcagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 10275 - DNA, 580 bp, Homo sapiens
agttgaatgaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcaga

SEQ ID NO: 10276 - DNA, 2271 bp, Homo sapiens
agttgaatgaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccaggggaagaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 10277 - DNA, 3256 bp, Homo sapiens
aggggcgcgcccgtgggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagagtttgctgaggatgatggcttccagctccatctatttccccgcaaaggacatgatctcattcctttttatggctggatagttttccatggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagtaatggctgattgtgtcattttttttcccca

SEQ ID NO: 10278 - DNA, 3041 bp, Homo sapiens
caaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagtaa

SEQ ID NO: 10279 - DNA, 1448 bp, Homo sapiens
gtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagc

SEQ ID NO: 10280 - DNA, 2317 bp, Homo sapiens
aacattatttcagggatacaggagggtaggaggttatgaggctgtctggggaggcccgtgagacccaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactg

SEQ ID NO: 10281 - DNA, 571 bp, Homo sapiens
gtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcgg

SEQ ID NO: 10282 - DNA, 2991 bp, Homo sapiens
attcctctgaaatgtctggcatgcagcaggaactcacaacattatttcagggatacaggagggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagtaatggctgattgtgtcattttttttccccatcaaaatccttgattgatttccctggcagagcccagagcaggctgtgcaagggcagggactagtgtgtggtcccacatggctggtgccctgccaggcacgttctcacttctcaagg

SEQ ID NO: 10283 - DNA, 2317 bp, Homo sapiens; identical to SEQ ID NO: 10280

SEQ ID NO: 10284 - DNA, 574 bp, Homo sapiens
gactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccga

SEQ ID NO: 10285 - DNA, 718 bp, Homo sapiens
aggggcgcgcccgtgggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagagtttgctgaggatgatggcttccagctccatctatttccccgcaaaggacatgatctcattcctttttatggctggatagttttccatggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgc

SEQ ID NO: 10286 - DNA, 2335 bp, Homo sapiens
ggctcccgcggccacgttgcagcccaggcggaggcgcgggatctcgagctgggatcgccctcttgggcttcggtgcgatcggcggcgggaggttccctgggaaccaggtggtcgaagggctgagctgtgtggccagacaagaggtccctgccctcccccagtgagccctgctgttcccgtgggagccatgaagctgaacgagaggagtgtagcccactatgcactcagcgactccccagcggaccacatgggcttcctgcgcacctgggggggcccagggaccccaccgacccccagtggcactggccgaagatgctggtttgtcctcaagggcaacctgctattctcctttgagagtcgcgagggccgggccccactgagcctggtggtgctggaaggctgcacagtggaactggccgaggctcccgtgcccgaggagtttgcctttgccatctgctttgatgcccctggagtgcgcccacacctgctggccgcagaagggccggcggcccaggaggcctgggtgaaggtgctgtcccgggcaagctttggctacatgcgcctggtggtacgcgagttggagagccagttgcaggacgcacgccagagcctggctttgcaacgccgctcatcctggaagtctgttgccagccgctgtaagccccaggctcctaaccaccgagctgcgggcctggagaatggccactgcctctccaaggacagcagccctgtgggcttggttgaagaagcgggcagcaggtctgcagggtgggggttggctgagtgggagctgcagggccctgccagcctcctcctaggcaaggggcagagccctgtgtcccctgagacctcctgcttctctaccctgcatgactggtatggccaggagatcgtggagctgcggcagtgttggcagaagagggcccaggggagccactcaaaatgtgaggaacaggataggccctaagtctgggccctttgagtcaggaaaccagggccagttctttttcaggagttaaatgtttacccatttccaaggttgcgttttgggaggggacatgggttctctccttcctgctatttaggcattctccaggttcgagatccacccgtgtgtctggaagggactgcgggaccattccttccatcctctttatttcctgaggtccagagaaggaaggagacttagcagccacagagcaagaccccaatctcctgactgcactggcctgactgccccctcccaggggatgttaatgaaatgaaggaagtggggaatgtcacccgagactgtcacaggcttgccatacctttggcctacacaccgggctctagagccataatttccaacctggggagtctcctgtgcacttaaatccgaggtaggctgcagtatcggcttgaagctctgacactgtcagagaaagtggatttattgtgtcataggagtttctgggacccagctcttcctgagaggggtgggaagattggggatgggatcctcactcagcagtctgggtagggccctttgaggcagagggtcttcggccagtgaagagagatttattctgctcagagtgctggggtcccatcctttctccctggctgccctgttaacagatggtgctggaccttgccccggaaggggcttgtagcttttttacgtcaacgaaatgccctcctgtactctgtcttcagcagccaactcctggagctgccaagtgaggggttaaagaagaggtggggaggcagtgtggctccctgggaaaagtctgttgctttggttctcagtcctgggtattctaggagcttggacacgggattgcgtttcctgtgctaaaattctctctcctggctgggctccggtaaactgaagctgctcgagaaatcacctgggaactctcatagccgtttgtcacccagggtgtacttgccaggacctctccttgctactcttcccaaagtcgggaggcaaagcggctgggtcaccagagcctgaccatactgacgctccagggggaagacgcagaggccgggaagagacaccccctcccaaacacataaaacttgccccttcctagcctcggctcccctcactggggccttgggcaggaccgacccgcatccaactaggcctaaggggtaggctctgagcctcttacccctaagaggcggagatgcgcccaaggcgggcgcccggcctgttccccagccctgcctggaagccccgcagccactgcattttgtttaaacacagatagcacgggcctttctcttattgctacagtgttttgtacacggttaaaacactagtaaagctttttcgttattactc

SEQ ID NO: 10287 - DNA, 537 bp, Homo sapiens
gcgggctccgggaggaggtggccccagggaaggtgtggccgcggggaagtggcggcgaacagccccgacgcgaggacggggaaaccaaggcggcagccagggagaccctgaccgaggttccctgggaaccaggtggtcgaagggctgagctgtgtggccagacaagaggtccctgccctcccccagtgagccctgctgttcccgtgggagccatgaagctgaacgagaggagtgtagcccactatgcactcagcgactccccagcggaccacatgggcttcctgcgcacctgggggggcccagggaccccaccgacccccagtggcactggccgaagatgctggtttgtcctcaagggcaacctgctattctcctttgagagtcgcgagggccgggccccactgagcctggtggtgctggaaggctgcacagtggaactggccgaggctcccgtgcccgaggagtttgcctttgccatctgctttgatgcccctggagtgcgcccacacctgctggccgcagaagggccggcggccc

SEQ ID NO: 10288 - DNA, 1794 bp, Homo sapiens
gaacgaggcggctgtggcggtggctgaggcggctgggcctagggtgcagcgggcgcgtctgcggctggtgttggcgcatctctagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccttggctttttcctctacgtacataccatgataaagcttaacaaagaacagtgagagattaacagcaaccaataactaataaaagctatgtgaatgtggtctctgtcaaaatatcgtgctgtaatcacccttcttgctatctgaaaaccaagaagaccactaagtgactaatggtcagagaagctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttcc

SEQ ID NO: 10289 - DNA, 5155 bp, Homo sapiens
gtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccttggctttttcctctacgtacataccatgataaagcttaacaaagaacagtgagagattaacagcaaccaataactaataaaagctatgtgaatgtggtctctgtcaaaatatcgtgctgtaatcacccttcttgctatctgaaaaccaagaagaccactaagtgactaatggtcagagaagctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttccaactatgtgttctcttggtcctcagaagtgtttgaatagaaaagtaacaactaacttcccatctttctggtggaagagttaattctgcctggagggttctgcctgggagacatgacagcatgtgtgtgactcctgtgtctgtttctgtggggtcatccctttcgtttcattttgccagggcctggctcaggattttttatggcagtgcctgtgaagacaagcctggccctccatccagtcacacaggaaatccacagagagcatgctgagagcagccagcggctgggctgccatcaggcctggtttatgatgccacaagtgaatggcacgtttgttcctctttatctctgagcattgaaggacttttggttaaaaaaaaaaattaagttcagagtaatccttttcatggaagaatcttcaggtcaccaaagaattgaaattttaagccccagattgtactgagctgtacctgtgggaaaaggaatggccagggtattgatgatggaaaagattcaaatgaggagttagaaggcaagccctctgtgggcagccgtcttccagaaacctcgaacttatgtctgtctccacctgagaaaggagaagaaaagctggtggtgacccctgctcctgctgggccatgccatggctctgaagatgccccgtgttcttaggaggtgctcacccctggcacctaaagacatttccttctggttgttgctctttaaaaacaaaataagcccctgaacgtgcttgcaggccagtttgtgtgcctgcacttgacgaattaccttgaccaacgggccaaaggcacagagctccaaggcatcatctttccttaaaatcctgagtgtttattaaaaagggacatggtctctaggtatcttattacatttgtatttcttacatttgaaatatcctaaccgctcccttcggtttcttcttaagaacatttacatctaattatttttcgtgcaagtcttgtaggacccacatgttttcctagctttggaaatcgatttttttcattcctcttatgaggatttccctatgtcagtaaacattaactttctatttcttccatttttgctcatttgaaacccctgctgcttctagatctatttctttgcacttgtataactttgaaataaattcctcatcccttagactaagagagtgggtgtctgtgaaaattgttttctccttcataatacctaaattctagtttgtcagtaaaatatttgtgtttggttaacaagctcttatttaagccattgagttagtataatctttattacctttgaaaaaccagagagctgaattttttgtcattctaagttgtaagtaacactgcagtcaagtcttctgatgaaatttccatatatcaaattgaaaataaagcaaaatatatttattactcataact

SEQ ID NO: 10290 - DNA, 3212 bp, Homo sapiens
actcggttgccgcgcgtggacttacaagcccacgaagccatcgttcgtcacagcctggaaaagggagggggcatcgatctggtttatgtttggacctcgaggctccaccagcgctggcgcaggcaggaaggagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttg

SEQ ID NO: 10291 - DNA, 3721 bp, Homo sapiens
gtcactcggcggcggcggtcgttccgggagcactccgggctccgatctccggtgtcacagcaaagatccgcgtctttccgatgaatccagccaatgccatccagtacacacgcgcaggaccggaggggccgggccgtgggaggaggctctgcgccgcggctgcccgggttcccctgcgctctgccctcggccgggtcgggtctccgcgggtgcgcgcagaggatctggctctcgccggcgcctgccgcccttatattcagccggccgcccgcatggctaatgagatgcaaatcagcagccccccaatctggcgagagctgtcacaaaggagccacttttccaaaccctcctctcaatggatcgccaaatgatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccttggctttttcctctacgtacataccatgataaagcttaacaaagaacagtgagagattaacagcaaccaataactaataaaagctatgtgaatgtggtctctgtc

SEQ ID NO: 10292 - DNA, 8057 bp, Homo sapiens
cagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgattcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaaggtctttcagagccttgaagaccaccatttggaagtggtggcgtttttcagggaaaatggcttccatggccttcttgcccatgactccgagtatgctctctacaatattccctcttactacagttcccatgctctgaaactgagctggaatgggaagaacctcactaccaaccagttcctgatgcaagaagtagccaagcagctgggcctgaagaggatgaatttccccatatttgctgcactgctaggtaaccacatcctcccagatgaggacctggctgcttttcactggagcctcttgggaccagaacatcctcttgcatcacttaaggttcgagctcatcagctggttcttcctccctgtgacgtggtgatcaaggctgtttctgagtatgtcagttccatcaaagatccctcaaacctggatgtagttgggaaggatgttttcaaacagtctcagtccaggacagaagataaaatagagcgattcaagaaagcagttgagtattattcagtcacaaccaaactctcttcgctgccagtgggtccctcctttctaggttttcggaataataggcttggaaatcctccccttccacgaaatcaagtgggcaccatttctgctggaaagccaatgttttctcatcaagtgccccagaaagtgaaatatccaccaccattcccagtgggacccaactcatctcttctcttctcctcccatgctttgggggaatcccatgctttttctgaggatcccatgctgcagaacagcccctttgccaattgggctgtctcctatgactcttctgcatcccagtttcccaattacctgccttctaaagcctcacctcctttgggaccagactcttcccactcctcttcctctgatggtgatgagccaaatggagctagctctgatcatatcacagaagcatttcatcaccagcctgagtggggaaatcccaatcgtgacagagggtcctgggcacagcctgttgatactggagtttcagaagcgagcctaggtgatggtgagccccacatcccatctctgctgtctatgtctacaaggaaccacatggatatcaccattccacccttacctccagtagctccagaagtcttgagagttgctgaacacagacaccggaggggtcttatgtacccatatatctaccatgtcctcactaagggtgaaattaagatccccgtatgtattgaggatgagtgtaacatggagctgcctccagctgctctcttattccggtcagctcgtcaatatgtatatggagttctttttagtctggcagagacacagaggaaaatggaacgcttggccatgcgacggcggctgcctgtggaagttccttcagtgatccttaaagagtggtctgcctataaagggaagtcacctcaaacccctgagctggtgtctgcactgacatttcgggaatggacttgcccaaacctcaagaagctctggctaggcaaagcagttgaagacaagaacagaaggatgcgggccttcctggcctgtatgaagtcggacacgcccagtatgctcaatccagctaatgtccccacccatctgctgctcatgtgttgtgtactccggtacatggttcagtggcctggtggccgaatcctgcatcgccatgagctagacaccttccttgcacaggcagtgtctacccagctttatgaaccagatcgactccaagaactcaagattgagaaactggatgcccgagggatccagcttgctgccctcttcatgagtggagtcgacacagctctgtttgctaatgatgcctgtggccagccagtcccttgggagcattgctgtccatggatttactttgatggcaagctgttccagagcaagctaattaaagcaggccgagagcgagtatctctggttgagctctgtgatggccaggctgacctggcaaccaaagtggaaaagatgagacagagcatccttgaaggagtcaacatgaatcatccaccgccttctgctctacttccgtcacctacttttgtgcctcccatggtgccctctctctaccctgtttcactttattcccgagctatgggctccatgccacttccccctcaagggaggagccggggatttgcaggtctccatccaatcccaccccaaggaggaaaactggagattgctgggatggttgtgggccagtgggctggcagcagatcctccaggggccgaggatccttcggcatgcaagtggtttctgtcggtgggccaggaaaggggcatggaaaagaacagactggtagaggatccaagggacacaaaaaaggaaataagcaaggctcttcagatggagtttctaaatccctggagcttcatcaaggtcggtctcgctcccaggtaaatggaaacagtggcgcattgatcaaggaagagaagagtgatcatcgtcttccagctccatcacaatgtgccttatccagagacagcaatgagtgtaataatggtaaccgctacctccctatgaataatagggagaagaaccacttacaagagcaaaagctagaaactgtggcacaacggaaagaggactgataagctgaagatggcttcaccaaaccaggaagagggaaaaacttttacttttctgattttaggcccaagctagaggaggatataaatgcttaccctagatttctccaggattttggtgggatgtcctattgtgtccatcttttccccttccctgcctgtttctgggacttcagattcagtggtctgtttctggagaagttctggtcaaagatgaatggcagtaagactaggtcctagtctcaaattgaagatatagcaccaatagtttatttatctcctctgggagcctagtaaggcagtagctgtcagaaattgggtatcatcacataaggtcctatagaaaagctctagctttggtttttctgagcatttataatgatactcattatcaaagacttatatgataaacctatgaggttgtggggacagctgtggcctcctgaggtttttttttgttttttttttttctctatgaagtggtatctacctcttcttcactccttccaacttacctacccctggattttgtaccaccacctctagctttggcctgacaatcagataggtagatgttttcagaaaagtaaggtagtattggttattttaatttttattttttattttatacacttcaaaaaaactatcaatggcctttgtactgggggattcaagtgaatcagaaaagtactgggcagatttttcctgcctctcaaccagtgcattgtttgtaaaatagaagatgtggcacagttcattcactccctattgcccacaccatgaaagggtgggaatcagtgtaatgaacttgagtacgaaagggactcaagagactgtgtgtgtgtgtgtgtgtgtgtgtgtgtgtgtgtgtgtgtgaatgtgtgcttgtgtgtgggtgtgggtggatgttgtgtgggtgggtgtatatatgaatgtgtgtatatgcatacacataccctttatataaagagacagatctatttatctatacatattttatatatatgtaagtgtgtgtgtatgtgtgtatatatgtgtgtatatatatatacacacatatatacacacatacatacatacatacatacatacatacatacatggtgatgtcccagaggatttactcaatttcccagaaatgcttccactgctatggagtggaaggtttcaaaagaccacacttttaatctgaaattcttactaagtcacagtgcattcacaactatgagaagttggatgggcttctctaaatcagacaaaaagtactttccagaaattgcctgttcagaacaataaactcttgggttgttacaagcttaatcttgaacagagccctcacatcccatatggtgaaaacaggaggttggaatgggattgggaagagttgggcatttccttatgaaggtttggagagaaaaggggggatgggaggtgactaccatttgaaagggctttcagccaatttggaggaaatctcttctggaactccagggtcaaattggtttcaggctagaattgattgacatgaatccctgaaggagagaggactagctttggaaagatagggtagggaagtgtgaggaaactatttgattttacacgcctagattgtttcatttgttcattgacattctgactactggatcttttcatttgctttgcaaggaagactttagaggactctggcctgggccttgagaagaattctattaaaagattctcagcctcctgtgtggccaggatctgcccaggataaagaggctattcctccttgctggagataatcttgagacaaccttgcatttccagtttccctccttgggcagcctaactatgagggagggaaacatggcttgcaataaattagcattgtgtcttcattcaggaattgaggcttccagcctcatatacctccttttgggctttgtgatattcttgcccaagaagtaccatttctacagaaatacaactgactaatcttctagcagggttctttttgaaaaaccccatgcaccttaacccacagcaggtccttggtgatttttgcccagacaaccagaaggctatttgcttactgcccacttacaatgaccagatcataggaaattgaaaacagtgtcagactatttagtcctaatctgtcccagattaagagaatccatgattttcagggggagggagccctgcaatgccttgacccctgcccagatacttcttacataaaccaaagaaaaatgacaagagtgtacatctaaccagacagaagtagaaacaaagtatagaaaaacctcctctttggaatcagctcccttaatgtggtcccccttctcttggacctgcccaacctttcacaacgtcttgaaggtaggacttctatatccagcaaaggaagggatagtagtaaatttacatggcttggaattttctttctggagccacagagggatgaatcctttggagctctaaaagcaaccagtatcactgagctgtgagatacctatatctccattttctaataggaagcacttggacttaaaattgctaagatattttttgcagttgctatttctgtgcatcttgaatctatctgacacaatcaaatgacagtattgttaactctcacaccattaagaaaatttcttattttgtaggcattcactgtgagaggtaaaattgctgctttggcaggtatgattccagtttgccaaacggcttttcttccttccacaacctctttttcccctagcccagggtgaaacaagtgggtcatctccaaccttgatttttatttggattcagcattttgggtttggaaggttacaagaaggaaccataaatggccatattcctagatttttatttatctgacaaaatacacaacttaaaagccaggaaaactaaggttcattacagggagatgaactttttctaattggaggacaaattgtggaaggtggggtctgatctttgcttcaccacttgaagagactgtcatccttcacctgaggttccatttctagcttttatgtgacctctcttgaacaaagtcatttgggaacccccagaaatgacccctttacattgtaggaccataagcaaaacactggttgtgtatagtcactgatccccaaggacttgcagttttttatttctgctggtgtgtcttgggatcagcttataactcctactcttacttagtcagtgaccagtccagtctggtctggaccaggcctgacaaacttctgctcacttgcatcattttcattctgagccagtaggactttgggtagactttaaagcccaagaattggtactcgctttggctagtgacatttgatttttgtctccatcttgatttctgacatcattggccaagtcacattaactttttttgatcactgagaaaaacagtcgaacaaggcattacagagggtggttaaggtagagggtggggggcaggaatgcttatgtaggatagaaagaatgtgggggtagctgtttggttatggtgatccagtcctttggaaccttacaaggctcctgtgggcatgtcaatgttaccattacagcctctacgacccacccacctttgaaaagtcagtacaagtagaccacagtttaaagtagttagtataattctactaaggtttaatcattatacttgttcacttcctggtgcatatttcctaaatatgcttggggtgtggggtggggggttgagttttcactgttccattgcgtgtcatcttatatttttctccatcctgtgactttggcatcttactcgactttctattttcttttcccttggcttattgcagtagtctgctggtgcaggtagagagctcagtgcacctattcccctgttactgctaattatcttgaatattgtcagaggttattttgatgttctaagaatataaagtcattttttacaaaatcatcttttccaagttaaaagcaaaataaaaaaatcccctgtgctagggtgcccatttcagcttttgacattgcccctgtacttttatagatgctctttttgtccgtgttggtagtaactaatgactagtgaattttcatgtaaatgaagcaaaataaatatttcagattttattaatctctcataacccagccaaatctgatgacttcattttaattgcttcccagaaagcacttcccctcctaccttctattctattctattctattctattctattctattctattctattctattctattctgttctattctgttctattctgtttttagaataacacactaggtaaagaaactttaactgcaaggagtcagtgacttttagtgctccctgataaatgatgttattgacaaaagtaaaaaattatttcattgtttttttcctgtattactatctcctctcctgtgcttttgacagtgtgtttagtggatggataatatgtatttctctttcccactcccagattccaaattccctgcctttttggcccacctcaccacaaaagctccatagtttattaatgtaagtttgaatggatgcttctttggggaaacttcaggagttaatggaagagtttcagaaaggaatgagaatgcctcaggagttgttctgtgatggaaattggtctgttgttctgttaatgctgatggaaagaaacttacaacgcttaataaaaatctattcttttagtaaaaaaaattgtgaaataa

SEQ ID NO: 10293 - DNA, 1140 bp, Homo sapiens
cacgcgcccgcccccagcttcgcgcccagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgattcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaagcaagctgccatgttgtgagctgccctatggagaggcccacaggaaaagaaactgagggaagcctccaaccaacactcagtgaggaactgaggccctcagtccaactacagcctgcaaggaactgaattgctgccaacagccacgtacgtgagtgagcttggaagcggatccttccccaggcaagccttgagatgactgcagccctggctggcaccttgattgaagcctgtaggagaccttgagccagaggacccagctaagccatgcctacagatactatgagataataaatgttgttttaagccactaagtttgggggctactttgttacacagaaatagataactgaaacaccatt

SEQ ID NO: 10294 - DNA, 8443 bp, Homo sapiens
atgggggagctacccaaagcctggggaaggggagtcagtgctggaggtgactggagccgcggcgacggcggcagcagctgcggtggcggcgctctcagccgtggcagccgaggctgcagcccggcccagggcggctcagcggacaataaccgggctaggaacctgaccgggctggaccccactgtgatgcttcctgactgataatgttataacagtgcctggaagcctgaggctgcatttccagctggacgtacctcagttgtccccatcatcatggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgagaagctcatgccagggaggcccacgccagggaggcctatactcgagaggcttatggcagggaagcctatgccagggaggcccacacttgggaagctcatggcagggaggccagaacccgagaagcccaggcccgagaggttcgttgtagagagactcaagtccgagagacccaggcccggcaggagaagcccgtcttagagtatcagatgaggcccttaggcccatcagtgatgggcctggcagcaggggtatcagggacctctcagatttcccaccggggaattacctcagctttccccaccactgcaagcagcgagccagactggagggacttccgtcctctggagaagcgttatgaaggaacctgctccaagaaagatcaaagtacctgcctgatgcagctcttccagagtgatgccatgtttgagccagacatgcaagaagcaaattttggaggatctcccaggagggcctaccctacttattcaccccctgaagatccagaggaagaggaggttgagaaggaagggaatgccactgtgagtttctcacaggccctggtagagttcaccagcaatgggaacctcttttccagcatgtcctgcagctctgactctgactcatctttcactcaaaacctccctgagctgcctcccatggtgacctttgacatcgctgatgtggaacgggatggggaaggcaagtgtgaagagaatcctgagttccacaatgatgaagatcttgcagcctccttggaagcctttgagctgggctactatcacaaacatgccttcaacaactaccatagtcgattctaccaaggcctgccctggggtgtgagcagcctccctcgatacttgggactgcctggcctgcaccctcgacctccacctgctgctatggccctcaacaggagaagccgctctctcgacactgcagagaccctggagatggagctctccaattcccacttggtccagggctacctcgagtctgatgagctgcaggcccagcaggaagattcagatgaggaggacgaagaggaggaagaaggagaatggagccgagacagtcccctttccctctatactgaacccccaggggcctatgattggcctgcttgggctccctgtcctcttccagtggggccaggtcctgcctggataagccccaaccagttggacaggccttccagccagtctccatataggcaggcaacctgttgcatacctcctatgaccatgtcaatatcactatcagtgccagagtcaagggcacctggggaatctgggcctcaactagctcgtccctcacacctacacctgcccatgggcccttgctataacctccagccacaggcctcccagagcatgagggccaggcctcgagatgtgctgctgcctgttgatgagcccagttgctcttccagttctggaggcttcagccccagccctctaccacaggccaagcctgtgggcatcacccatggcattcctcagctgcccagggtccggcctgagcacccccagcctcagcccactcactatgggccttccagccttgacctgtcaaaggagagggctgagcaaggtgcctctcttgccaccagctactcctccactgccatgaatggaaacctagccaagtagttattatcaattctggagtagggacacggggcctgagcatgtgaatggggatcaggggttgggcagaagggtgggggggtgggggttgttgtttaacttgaaaaccctttgggccaaggaaaactcctgtgagttttcaccttggttttcccacttgcctcttctgccatctatggccacgttcaactcaagtgcatctgcccagggaggctgctgctgctactgcactccagtttttgctttcgaggtttcttcttgtgacccacgctgggtttgggatgctgtaattttgtgcctattccagttgccaagttagtgattatatatatatatatatatatatatatatatatatatatatatacacacacacacacacacacacacacacacatacatacacacacacacacaaacacacatgcacacacatatatagcatgcatccttgacacaggctaaacctttagtgccccctgcccctttcccccaatgaatgatgaaccactgattagcagccaagtctgcattgcctcccgcttggggaagtggggcttatttgctattagcaatgtgaaattatggtacagatcctccccacccctattccttttggcctggcatagctgccatcattatatcagatgactataagctattcatcccagctagctgtccttagagaggatcaagtagcgtgtgtctcacagcctatcgctgtggactttggcatcatgaccagatgggggccttttaactgtcctgccatagcttgggttaaagacaaaaatgctaatccccttgatggagtgataaaattcatccatttgcaaacagaagacaaaacaaggttctgttgtggacactgccatagagtgttgagctccggaatgataggattttttttccttcttttaagcttgtgactacctgagttgcagatgcttttgaatttttgttcttttttcctctaaaggaaattttcataatctcatcacaaggaacacggtcttttaattgagataagggaagagaagcaacctaaattaggcttgactataggggctggggtttttgtggagtgtaggggaaagatagaaaatgagggtccatttatcacagccagcaagaaaggggatttcagaccatgcagagcttaaggtatctcagtttcttaaaagggaaaactcccttctcaagcctcccaacacaaaatgttccttaagccttgcccatcccatcatttggactctgtaataaggccccaggtttgcactcccaagacaggataccaaaggcatctcagctgctgttctgggccctttaaagagcttttatcttccaattagccgagtccttagcatcatcaaatgacagggcttcttggcagttgcagccctttatggaatgaatggcaccctcccttctcctgcatccatgcagttttcatgttaaactaggttggaaatactggtggggaagagcttgctgtcaggaagacattggaacaggctaatcttgccaagctcaacctctcattaatcacctgtaggagagggttccttttacatgtctttattggaaatggcatatggaacattttttgcttggctgtgttcactcaaattatgattattgcaccctcgccctcacatcccaccatctccatgcctgttgagagaagaagtcaacagggttcttgccattcctgagatatggcaatttagcttgggaacagatgctgtttgccccctaagtcaaggtgactttgtgggcaaactgtttcttggccaggggatgtgtccatgctggtctttgtcaccatttctcagattggggttggcccagtgcccttactcacaaatagcagacctggctggtagaagctgcacccctggaagcaccacatgaatttgcatggcactaacaccaccactcaagggacccagaccagctcttcaggctgactttggctacagatacattgtgaagaaatgtatctgttgtggagctggagaatgaaagagggtgaggaaggccctccttaccccaagcacagcattccaagagagaagtgcccaaattccaactttctggcctcttaccaaagctgctctgggatggtggggctgaaattggcctggctatttggcaggaagtaaacactcaccaaatgcctttacaacagggaagaacccacctcttgcctcttctttcagggcagcttgagctcctgtctacatgtggactgtgccagccacagcaggcggtagagccatcaccagcctccagaccctgctggagaagggccaccagcctatctgggaagagaaaaaggaggtggccaacctttggctaagggctgagagctgccctcaggatcaggaaggcagcatgaggcattgtctctgaggggcactggcatagccctgacacactttgttgggctttggaaggtcacacaccacagagtagggcctggggctgagtgagagttcatggtttggacagccttgctgcctgcaagtcccttcactgccctagccagcccaggaataggatccttaccacctgaagtggggcagccaggatatgtggctgcagaagcaggttcctttgaatttctagagctaagcagtttgtggctgaaacccaatggcagcctaggggaggaaggaagacctgtctggggacccatggtgttgacagcacagggtgacattgggagagccagccaagcttcaggcctgtttccaaacacagactagtgctggcttgggtggcagcaaatacaccccagaccactaaaactgttgatatcatgtccacacctccaagagtactactagatgaacaacatgtctccattgcaaggtcctggaataatgcttttggatgtgattttaagggaaaatgggacttagtggaagtagctgccttcatcttattacccaataggcctagtgccagacagctgtgatcctgagaattcccagatgagactggtccttggaggaccagtgaatgtggatagagaaggccacctagtaggcctctcccagggccaggatgccagtttcttggtgctttagagtctccaaggaagcactgccttggggcccagttcaagccagccctacctatctggcctcagcttgggtaccaggccacaagactgcccggataatgggttcagtaaacaccagtctctctccctccttagtcctatgccaagaagggaagtagcttcacacactcaggaggctgggtgtgtacccttcatcctgctgccagcagctttccttacctgtgccagtgccaccaccccacctgccctcagcccccaggcccagttgctagagggaggcatggggtttagcagggagacttcaagtttacccatgtgtatgttgcattcaagttgtttttaatatatatatatatatatatcaaaagtcaattatctatttttatattgtttgcattttatattcatggaaaacaatgtttatcaattgttcttttctgatttatttttaagcggtgctgtttacagttttaaacaaaacaaagatgacacaaaaattgctgctgcttgtgcagagggctggcatctcaactgcctagggccctccctctttcccctctccctaccttagctgtaccacactgtccgttccctccccccatgatagggacagcagaagatgcccaggtactgaagacaaacgccaagtgactcaggcgtgtgggacctggtagacagcttgtcattttctggctttattttatgtttttctttcttttgaacccttcttccccatgtctagaccctctgagagtactcatgtgtcttattttttttcctcgttatgttttgtgctttagttttgaaatcagagtgcccatgttgtgctatttgtcttgttgagtttctccaaaggagcattttgggaacattctccacccaatggggaaggaagggggtttcaaccatgtcccctttccccaagaagctgtgggagacagatgacaatgatgcttgcactatcaggaatttaccatctcgttgaggaaacccttgcataggacttcctaggagctcagttgattgtgacattttcccagaagagaggctttggggaactccttcacccctcttgctgctttgggggaatctcctcccctaccaccattccccctcccctgccctgctccagctcacacgtggatggtactttggggaacagtgactttcagggtgatggcttgctggcctgatccctgactttccaatcctatagtcactccaaagaagaaaatccacatggtatgtatatgtgtgagggttgggtctattgagaggtgggactttaattattgttattattattggtgcttatttttcctgctgtatatgggggtgggggtgggggggaataaaacaggaatgtatatttaggtcatgttaaataaaatggctggaggaaggagggaagaaattaggaactgcagtacatcatcaccccaggtgtaagagttatttctctcccagtgcagaaaggggagtgtggcccctggctgtacctgagcttcctcttctccatccctgagacatcacagaatcacccgggttctgacctctccacttctagctctcactgacatctggatatcttgatgcactgcctgtttgtaacaacatatacttctttgctgaatgctaataaacttctgggttcaagagggaacccctcagtca

SEQ ID NO: 10295 - DNA, 2415 bp, Homo sapiens
atggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgagaagctcatgccagggaggcccacgccagggaggcctatactcgagaggcttatggcagggaagcctatgccagggaggcccacacttgggaagctcatggcagggaggccagaacccgagaagcccaggcccgagaggttcgttgtagagagactcaagtccgagagacccaggcccggcaggagaagcccgtcttagagtatcagatgaggcccttaggcccatcagtgatgggcctggcagcaggggtatcagggacctctcagatttcccaccggggaattacctcagctttccccaccactgcaagcagcgagccagactggagggacttccgtcctctggagaagcgttatgaaggaacctgctccaagaaagatcaaagtacctgcctgatgcagctcttccagagtgatgccatgtttgagccagacatgcaagaagcaaattttggaggatctcccaggagggcctaccctacttattcaccccctgaagatccagaggaagaggaggttgagaaggaagggaatgccactgtgagtttctcacaggccctggtagagttcaccagcaatgggaacctcttttccagcataagatgcccaggtactgaagacaaacgccaagtgactcaggcgtgtgggacctggtag

SEQ ID NO: 10296 - DNA, 6129 bp, Homo sapiens
gagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaaatgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttacagatgtctttttgtcattctttaacaatgaatttcccctgtgcatagttattaatagtattggtattattaaaaactaatttggcattttaagattggcattttaagcaagttgaggtgcttaggaaacattgtagaataagtttggggaaatgttagctgacagagctgagagatcagattttcatgttctatcactgtaatggaacctcatttagacctctctagacctttgctagctgtgtggtctgaggaccagtaagtaggattggcattatctggtatcttgttaaaaatgcagaatttcatgccactctaggtctactaaatcagaatttgcattcttaacaaggttcccaagtgatttttatgagaagaaagtatcagagtgcaaacaaattactcgtctaatatgtagaattcccagtggtctcacagccctagatcaaatgtgtcagacactagatcattataatcttcattggttttgacagctaattaattagtttaataatattgacatatggcttcttaagtatttgaattctagattgctaatgatccttatttttgcagtaaaaaagtaacactttatatttttcttgttaactataaatggaatcagagctgtaaatgcctgaaattttaagtgtgaaaaggggtgccacccttttatatactgcacaacaaatttgcatttgtatattctttttaaaaaatctctgaagacttgctcagtgaaatggttctgattttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctatagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcacaataaatctgtattaaagggaagcacatcaaggaaatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtactttatacaacaagtgttgcctcttgttttattgaaataaaaactgaaaaaaata

SEQ ID NO: 10297 - DNA, 1236 bp, Homo sapiens
cgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattg

SEQ ID NO: 10298 - DNA, 3957 bp, Homo sapiens
ggcagggagggggccaaggcggccggctggagggacggggcccgaccgggagcggagccggagcggaagccgcagccgggcggcgggagcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaa

SEQ ID NO: 10299 - DNA, 3760 bp, Homo sapiens
caggaactgggccagttccggtcccttccttttggggctctcactctggaggatggggtggatgggagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagcca

SEQ ID NO: 10300 - DNA, 2028 bp, Homo sapiens
agccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggttcccatcatccctccctgatattgtattgaaaatattatgcacactgttcatgcttctactaatcaataaacgctttatttaaagcc

SEQ ID NO: 10301 - DNA, 5858 bp, Homo sapiens
ccttccagccatgtgggttcagcggaaagagaagcaaaaccactcttcctaaaatgttagaagctgctcttcgcttaccttggggcctttgcattgggagctgtttttcacatcaaagaatatgtgctgaatggaattttagtattttgctgtcgttttaatattttcgtctggtcttcctcagttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcatgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagatcccaaaatccaggagtgagggatctattcaggcccacagagtactgcaaccagagctatctgatggcattcctcagctcagcttgcggctaagttatagaaaagcctgcttggaagacatgaattcagcagagggtgctattagtgccaagttggtacccagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttc

SEQ ID NO: 10302 - DNA, 4945 bp, Homo sapiens
attgaggagcagaaggagtagggtgcgggggaggaggaggagcgcctttagtgctgcagcagctgctgctctgattggcccggtggttcagctgcttccctggaacaaaaggtcaaagtggactgcagtgtaaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattgaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttc

SEQ ID NO: 10303 - DNA, 3169 bp, Homo sapiens
attgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgt

SEQ ID NO: 10304 - DNA, 2206 bp, Homo sapiens
ctattaatgaaagccaccaggtgactggcagttttcggagtcaaagaagcctgtgtgtaggatctagggagtcaggtttgaaaaaaagatgtcagcgacttaagacccgtgtcacgtgactccctctacttgccagcactgaggctgtggatcaaatttcaactccaggcagtccttccagccatgtgggttcagcggaaagagaagcaaaaccactcttcctaaaatttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcagtaagttagtggagttttactgttaatatcatcatgtccccctttgtgtttactactgtctgaaattactgggatgtagaagcatatttcagtctgaaaattcagccagcttattttggagaagttgtatcttgttcttgggcatgttagccttgtttttcatcccaatttgaagaaggtagctatgccctttttacaaaactataatttgcaataaatcaaatagccttatttaaaaatctggaaataagttatattttaattaaaaggggcatttaaaaaatctgtaatcagaaatgttgattagcagaaagagaaggagtatgacatagtgaataattttttaaatagtaataaagttcaaattattgccaatagatggaaaattatgaacagactatgccagtatcagaaaaatataacctcagcttcatttactggaaataaaccagtctattttagtagattctttgttgctagccacaggaacttttgtaaagcttaatattttattctccttcttattccataaagctctttaatttttgatacgtgaaatgtgatcctgcaatccagggactttgcttttaactctcctattaatcacctctgatatcaaatacattcttctagttaagagagagagaacatttacactccaaaagctctcagaaactcagcaactttttttttaatagcatatctacttctccacttcattaatatacaggcttattcagctgcccagaactagtaatattacagtcttcagaatgactgtctaaatttagattctggcttagatcctagtgactacagggttccaggtcattcacagcctaatttgggtagaagttctactgtaataactatcctgattgtaattctaaaggtgttaacttttaagtaatggcatttcataggatatgttagggtctcgtgaataaatatctcagatgcaggatccactaattttttgtcttattcagaagctccgtgatagtaaaaagtctatattttttcttatatttgttctgcccagtaaacctttgtttggtgacttacatgtgagaaaggtgtaagtagaaaactgttgaataattctgaaacctagattctagaacaggtaaaaatgaatttgtaaatagaatgcttatttagtaagcattaaacacagatccatacctcattactaacttagacattgggcttgatctggaatttctggtaatctgctccaggtagtcagtcagaatatcagtaagtaatgagtatttattataggttctaattagtatggttttacagtttttctattgttgtaaaatatacataaaataaaatatacc

SEQ ID NO: 10305 - DNA, 3268 bp, Homo sapiens
accgccgccccgccctcggcggcacccacacccaggcgcgcccgcgcgcgcgcccggccccgtccctgtctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaa

SEQ ID NO: 10306 - DNA, 3145 bp, Homo sapiens
atccaatgaaggttactggctgagcggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccaactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaa

SEQ ID NO: 10307 - DNA, 3762 bp, Homo sapiens
ggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggctcagcccgctggggcatcggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgtggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaaggagatcacttgaggaaaagaaaatgttggaagaagagagaaatcggatcctaactaaacagaagcaaagaatgaaagaattgcagaaactcctgacaacccgggctaaggcttatgactcacatcaaagtttagctcaaatatctaaatccagagtaaaatgtctcagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacattatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgtgagttataatctaaattaggggcaagtatccctttttttatatgatgaaattgtgcataataacttggctagggcaagtctccaaagtaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtg

SEQ ID NO: 10308 - DNA, 3684 bp, Homo sapiens
atagcaaccggctccctagctaggcgcccccgggttgccaggggccgcaccagctttcccgtcccgggccagcgcaggcgctcaggcctcggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggctcagcccgctggggcatcggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgtggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacattatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgtgagttataatctaaattaggggcaagtatccctttttttatatgatgaaattgtgcataataacttggctagggcaagtctccaaagtaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtg

SEQ ID NO: 10309 - DNA, 4094 bp, Homo sapiens
aaaggagcagcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactataaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaaaaatg

SEQ ID NO: 10310 - DNA, 2992 bp, Homo sapiens
gtgtgccctccgcggggcatgatggggtagctggagatttccatcatggcggcgtccatttcgggctacaccttcagtgctgtgtgtttccacagcgccaacagcaacgcggaccacgaaggatttttactgggagaggtaagacaagaggaaacgtttagcatcagtgactcacaaatcagcaacacagaatttctgcaagtaattgaaatccataaccatcagccttgttcaaaactttttagtttttatgactacgcaagcaaagtgaatgaggagagtttggacaggattcttaaagatcggagaaagaaagtcattgggtggtacagattccggcgcaatacgcagcagcagatgtcctacagagagcaggttcttcacaagcagctcacccgcatcctcggcgtgcccgacctcgtctttcttctcttcagcttcatctccactgccaacaattccactcacgctttagaatatgtgctcttcagaccaaatagaaggtataatcagaggatatcactcgctattcccaatctaggaaatactagccagcaagagtacaaagtgtcttcagtgccaaatacttctcagagttatgccaaagtgattaaagaacatggtactgacttttttgacaaggatggagtgatgaaagacatcagggcgatttatcaggtttataatgcacttcaggagaaagttcaggcagtgtgtgcagatgttgaaaagagtgagcgagttgttgaatcttgtcaggcagaagtgaacaaattaagaagacaaatcactcagaggaaaaatgaaaaggaacaagaaagaagattgcagcaggcagtgttaagcagacagatgccgtctgaaagcttggacccagcgttcagtcctcggatgccgtcctctgggtttgcagctgaaggcagaagtacacttggagatgcagaggcctcggatcctcctcccccttactctgattttcacccaaacaatcaagaaagtactttgagccactctcgcatggaaaggagtgtctttatgcctcgacctcaagctgtgggctcttccaattatgcttccaccagtgccggactgaagtatcctggaagtggggctgaccttcctcctccccaaagagcagctggagacagtggtgaggattcagacgacagtgattatgaaaatttgattgaccctacagagccttctaatagtgaatactcacattcaaaggattctcgacccatggcacatcccgacgaggaccccaggaacactcagacctcccagatttaactaaacaaaagaaactctccacctagcactgtttttcttcattgcttactgagagggtttttgagaacttaatctggggggagaactgctttctcagataccttaactcccgagaagagagtccttgtgcacagaacttgtgggagcctccatccgctgctctttacctttggatacagtgtgcaagtttcatgacagaatcattaagataatcaaattgtcctaattctggtgcgattcatggatatactggtaaatttaggcaaagtgaaacttatcagcgtagtttctgttctttaaaataaattggaaattagagactaagcacaattagtctataaatgttctataaatcaaaaacttacctcttgcactatcatgccttgaaatttactttttcaaagggaaacaagtttagcagcagccttcaaagaacttctttctatgatgagccaaattcatctttgccagaaaagaaattttgataattccaagaagcctgattagaacaaatcagatataccttctcttgtctgcatgactttgtgagataaaagagagggcttccaacttttttctactagcttgatatgtattatcacttaaaatggttgcctttaaaaaaaaaaagtagagatactaattaccagtaagtaatcatccaaataaatacgtcataaaataaattaattattttttctttgatggattacagtgactactgtgttgcactggcacatttatggtctctgttctggaatcttggaggacacacagcagtggagaacagaaggagtgagttttataatgaacagattccagacacggtaggtttagctgagttcatacagaggagatataactcatttagatcttctgacaaatcctagtgttagttttatctgtggaggaaagacatttaataataaactgtttgggaatcttggtgaataaagattcattttcaagctgaataaccatacttattttattttaagttgccatttggggaataattgcagtatgtgtagagactctcttgggatgcacttatatttttatttaatgactacttgttttctagttttgcccacaacgtctgaaaccactaagacattcaggagcatgttgagcttctggtttggaaacagcaagacccaccatttatgacaaggacagccatgaggttaatacttggagtttaactgccttccctttgaactagttaaaatctgtaagaataaggaagttgttgaaggcttaaaatctgggttctgaaaaagtagtttcagtttataggatacacatttactcactgagctccagttccaatactaaattagacagtatcatatagacggaaaatgaaatgctagaactgccgttctttggatcgccactctatgggggtctgtcttttaactactctcctggttatgttggccttacaccactgccatttgatttaaaacgctgcagaccactttatctgcaaatgtgttccagttgttatcagctacctactacgcagcttcagcgccagtgtgaatttatttttttttaagtgccattaccgtctcctctgttcagattttgacattcaggaaaatatttttattttgatgccatactgaaatctacaatgtatatctgacaaagcagttaaatgtgacaataaaaaacttatttaatcatggta

SEQ ID NO: 10311 - DNA, 6894 bp, Homo sapiens
acttccgaagagagaaccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcccactgggagctaaattccagttgtcactagcttcttactgcagagaacgagaactaaagaggttgagaaaggagcaaatggagcagagaatcaactccgagaattctttctcagaagcaagcagtctttccttaaaatctagtatagaaagaaaatataaaccaaggcaggaacaaaggaaacagaatgacatcatacctggaaaaaataatctgtcaaatgtggaaaatggacatctctcaagaaaaagatcctcttctgattcatgggaacctacttcagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaaca

SEQ ID NO: 10312 - DNA, 3712 bp, Homo sapiens
ccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcccactgggagctaaattccagttgtcactagcttcttactgcagagaacgagaactaaagaggttgagaaaggagcaaatggagcagagaatcaactccgagaattctttctcagaagcaagcagtctttccttaaaatctagtatagaaagaaaatataaaccaaggcaggaacaaaggaaacagaatgacatcatacctggaaaaaataatctgtcaaatgtggaaaatggacatctctcaagaaaaagatcctcttctgattcatgggaacctacttcagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggtgtcattttgttatacaatttcatgtattcttaatagttttgctgaatggcactcttcatactgtttgaaataaaatagggtataacagtgca

SEQ ID NO: 10313 - DNA, 2931 bp, Homo sapiens
acttccgaagagagaaccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcccactgggagctaaattccagttgtcactagcttcttactgcagagaacgagaactaaagaggttgagaaaggagcaaatggagcagagaatcaactccgagaattctttctcagaagcaagcagtctttccttaaaatctagtatagaaagaaaatataaaccaaggcaggaacaaaggaaacagaatgacatcatacctggaaaaaataatctgtcaaatgtggaaaatggacatctctcaagaaaaagatcctcttctgattcatgggaacctacttcagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacaggacatgttcatcctggaacttacacaaataccttagaacgtctagtgaaggaaatggaagacacacaaaggtttgttagcataaagattaatttgctaaatttaacattttgcttgtttgtgtggcttacttttaatttaccttttttaaaaaatcatgagaaattagcgtgcattttggactctgttgtcaactgtgttagaataagatatgttggccggacgcagtggctcatgcctgtaatcacaacactttgggagacccaggcaagattacttgagcccaggagttcaaggctgcggtgagtcgtgatggcgccacttcactgcagcctgggtggcagagtgagacccagtctcaaatgaaaaaaagaggccaggtgtgatggctcatgcctgtaatccagtactttaggaggccaaagcaggcaaatctcttgagcccaggagtttgagactagcctgggcaacatggtgaaaccccatctctacaaaaaatacaaaaattagccagtcatggtgccacatacctatggtcccagctactcaacaggctgaggttgggaggatcacctgagcccaaggaggtcaaggctgtagtgagctgtgattgagccactgcactccaatctgggtgacagaataagaccccgtctcaaaaaaaaaaaaagtggggggccaggcgcagtggctcacgcctgtaatcccagcactttgggaggccgaggcaggtggatcatgaggtcaggagatcgagaccatgctggctaacatggtgaaaccccatctctactaaaaaataaaaaaaaaaa

SEQ ID NO: 10314 - DNA, 1435 bp, Homo sapiens
atgacacgcattacagagctctggagcagcccgcagtggaaagttggagctgaggtgtgtggcaggcagatgagggagcagagaactgctgaacagagtgagactcagaggacgtggttgagcatggctgcgaccctgcagttcctggtttgcctggtggtagccatttgtctcctctctggtgtgactacaacccagccccatgcagggcagcccatggacagcaccagcgtgggaggtggcctgcaggagccagaggccccggaagtgatgtttgagctgctctgggctgggctggagctggatgtcatggggcagctgcacatccaggatgaggaactagcgtccacacacccaggccgccgactcagactcctcctgcagcaccacgtgcccagtgacttggagggcactgagcagtggctgcagcagctccaggacctgcggaaggggcctcctcttagcacttgggactttgaacatctgctcctcacaggcctgtcctgcgtctaccggctccacgcagctagtgaggctgaggaacggggccgctgggcccaggtcttcgctctcctggcacaggaaacactctgggacctgtgcaaaggtttctgcccccaggaccggcccccttccctggggtcctgggcctccatccttgaccccttcccctgaccctcctcttttgttctttcacctgccattaccccctcccatctcctcctcaaccccccaggcagacccatcttgcgcaggggcttctgtctggcatctgattcttttcaccgtgttcagatctctgggcttggcttgcaccctggacaccccctctctgcttaccccgaccagatcttgtttcctagatcttgagaggctaagaacccaggctctgggtcgcaaggagtgcgcaaggagtgggcacagagctaagggcacgacttgcaggcagtgtgtgtgtgagtgtgtgtgtgtgtgtgtgtgtgtgtgtgtgtgtgtggagatcaggggtcagggttgagaagtgtgttcaagagatgctgaagggaagctgccccaagtaaggcctggtcagaccttccaactcctaccctggcagtctgtgacaggtcctgtggaattcacaggaatcctctaggtgctgagcatccccttttaggcacaaccaaggatttggggtctctgagcctccaagttcccatctgggttgggagaatcgactttttgagttctgtcagttggaagagtggagggaagcagggggagggaggaacattatctcttttggggtagggaggcaatatctcaacaagcgtcgggtgaatacctcagaggggggagtaaggctgggagaccaaggagagacaagcggaggtgggctggagcaggtgtggccctgattctgtgttgctcttctcataaaatgttctgtttcggc

SEQ ID NO: 10315 - DNA, 1388 bp, Homo sapiens
agctgaggtgtgtggcaggcagatgagggagcagagaactgctgaacagagtgagactcagaggacgtggttgagcatggctgcgaccctgcagttcctggtttgcctggtggtagccatttgtctcctctctggtgtgactacaacccagccccatgcagggcagcccatggacagcaccagcgtgggaggtggcctgcaggagccagaggccccggaagtgatgtttgagctgctctgggctgggctggagctggatgtcatggggcagctgcacatccaggatgaggaactagcgtccacacacccaggccgccgactcagactcctcctgcagcaccacgtgcccagtgacttggagggcactgagcagtggctgcagcagctccaggacctgcggaaggggcctcctcttagcacttgggactttgaacatctgctcctcacaggcctgtcctgcgtctaccggctccacgcagctagtgaggctgaggaacggggccgctgggcccaggtcttcgctctcctggcacaggaaacactctgggacctgtgcaaaggtttctgcccccaggaccggcccccttccctggggtcctgggcctccatccttgaccccttcccctgaccctcctcttttgttctttcacctgccattaccccctcccatctcctcctcaaccccccaggcagacccatcttgcgcaggggcttctgtctggcatctgattcttttcaccgtgttcagatctctgggcttggcttgcaccctggacaccccctctctgcttaccccgaccagatcttgtttcctagatcttgagaggctaagaacccaggctctgggtcgcaaggagtgcgcaaggagtgggcacagagctaagggcacgacttgcaggcagtgtgtgtgtgagtgtgtgtgtgtgtgtgtgtgtgtgtgtgtgtgtgtggagatcaggggtcagggttgagaagtgtgttcaagagatgctgaagggaagctgccccaagtaaggcctggtcagaccttccaactcctaccctggcagtctgtgacaggtcctgtggaattcacaggaatcctctaggtgctgagcatccccttttaggcacaaccaaggatttggggtctctgagcctccaagttcccatctgggttgggagaatcgactttttgagttctgtcagttggaagagtggagggaagcagggggagggaggaacattatctcttttggggtagggaggcaatatctcaacaagcgtcgggtgaatacctcagaggggggagtaaggctgggagaccaaggagagacaagcggaggtgggctggagcaggtgtggccctgattctgtgttgctcttctcataaaatgttctgtttcggc

SEQ ID NO: 10316 - DNA, 2955 bp, Homo sapiens
gcagcgccggcttcggatcgggagttggccgtcagctgcgccagaggcaggtgccagcggagagtgggtgggggtgccggcgccaggccaggctcggggaggccccgcgctacctctgcctctaggagtccaggcgcacagacaagctccccggagccgctcctgcttcgccaactccccactcgcgccgcccgtgccagccgccggcactggcgtctccgccgcccgcaggaggagtcgcgggagcactagcagccgccgccgagcgacagcatcctcaggagagacgccccgggctttgcagccggcggcctccgtccgccctccgcggtcgccccccgccccgtcgcccgtccgcccgcggtggcagccggcgccggcgccccggggcccttcacctgccgcgagcgtccgggcgggcgggcgcacgggagaaaaggcgcaagaagcgggcaccccgggaaccccattccctcggctcactcggcgcggagaagcgacgcccgctgactccgagagccccggtgctccgtgcacctggtccccaagttgaggagcgacacccctccacaggggactagcccgcgcggggagcattccggtctcactgaccccggcccacccgcgggactccaggcacctcttctgcccgcaccccgcgacccctcccgggaccccggagacagccggcctgcccccggcgtcccccttggccagcacgccatgccggggctgcgccgggaccgcctactgactctgctgctgctgggcgcgctgctctccgccgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaa

SEQ ID NO: 10317 - DNA, 4274 bp, Homo sapiens
aaaggcgcaagaagcgggcaccccgggaaccccattccctcggctcactcggcgcggagaagcgacgcccgctgactccgagagccccggtgctccgtgcacctggtccccaagttgaggagcgacacccctccacaggggactagcccgcgcggggagcattccggtctcactgaccccggcccacccgcgggactccaggcacctcttctgcccgcaccccgcgacccctcccgggaccccggagacagccggcctgcccccggcgtcccccttggccagcacgccatgccggggctgcgccgggaccgcctactgactctgctgctgctgggcgcgctgctctccgccgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaaaataaaagagggatttgctaagaatatcagaaaaggagtgttccaatttgaagagtattacaattgaaataacatcaaatatgtcacactaagcagccagtaacagaataaataattacaacgaaggaaaaaaaaaggaaagtcctccaaggtcaggatggcatgggaacaggcctagcagggacacaagcctggagtaaggcaggaaaagagccaaggctgactacagcccaccaaccacaatcttcttccctaagaccccaggattgtccccggcccatccccaaaagaagaaaggggctatgtggaaaggtgaggccctctagatgcccctccctgtgacggctggctcaaaaaagactaagtcaggttttttattgaagcctcccttagaagaaagtgtagtagggattccttgtctcctctaccttctccctgacttgttgatatctgaaactccttttaataggaggctttgtttcttattccataattaatgaccgaaaacacaaaggacagtaaggtcttcattccatggagtgactagtcagtcaacaaaagtaaaaatgcctcatttcatcaaatcaacttttccagtaaaggccagagttcaaatactgtaagcatgagaatagaatggagctgtcactaaagagagtacaaggtcaagaaccagaaatgtctccaagctttctgcagtgtgagcaaagatagcctcgactggacaaataacacttctgaccccgtggtacccccacatgactggtatgctgcccctggactttgtgtctctctaaaatcactaccattcactgagatctgaccaggtgaggcactcaccaacgctacagaagcaacacacaggtttccaatcctctcaaacacagatacaacccccatcctccaatgtgcatggaagaactttaaatctcagagagagtaagcaaaatcacacaatttagtggtttagacctattccaaagtcttcttttcactgtaacacaaaacccaacagtatcccacccaatttatgaagtcaaatttgtttgcttaaaaaaaaaatcagctgggcatgggctcacacctgtaatcccagcactttgggcctaaacaggcagatcgcttggtctcaggagctcgagaccagcctgggtaacatgacaaaaccctgtctctacaaaaaaatacaaaaaaaaaaaaatttttttttaaatcaactctttaacagagaaaccttaatcccaaagatttccttaactgttgtggccctactgcagcatagggctccccacttcattcactgtctctcctgcttcaagatgtttcttccctgtggatgaagaaccaggagatcacacacagaaatgggaaaatatctgggtaaaaacattcaaagaatagcacaaaatggtttgggacttccaaataagactctcaggaaagcaggctacagctctacctcaaaacccgccacctcctataacgaaggactggttttccaatggcctatatacacattttgctgcactctacaaacagaaagcaataggcttgaatttcaccatgatatgtggtacacctaccttattattcacttatctttcaaccttccattactttttgattagtaacaaaattaagactcatttctcaaaaatatcagaaaaccaaccgtttcattcttactcgagttcttccagcatgttcattttgaactgtttacctcccatgaaataaaaagtctcttgactctg

SEQ ID NO: 10318 - DNA, 2080 bp, Homo sapiens
aagaggagtgagttggtccccaggccacacagcccagtccttgacagtagccacagaccctgtaccagggacttgttgctagcttggcttttgaatctgaaaagctgcctcaatactcctttgccccatttcatattgatcctgggatcagcaggcctgggtctgttctcccctttagttcatttattcagttctaaagaaccttccatatacccaacactaggtgttatgggatacagaaatggaagactcagactctctccttgagaagctccttggtctagtggggagaacagacatgtagccagatcacgaaaacacagcacagcacttgctataaccagggagcacacgagaatcccatgggagggacacctggttcccgagcaagccctgggagaccaaggacctcactgctgtatccccaggacctagcaccctccctggcacatagcaggtactccacactagctgactgagtgaatcgatccatcagtcaagccgtcatgatcatcgtgggaaaagaagtaaccaggcagaatttctggaggacatgacagatcctaagggactctgtgaaggctgagaagagccctcggatgaaaatgggcatcggagcattgtaggcagaaaaccatgtgtgagagagaaagggcaggaacagcccatggaggtgctatgagtggcgcagggtccaagaggcttggtgagagggactgtggagggacgaggaagcaggtgagggtcactacctcctcctttcctgcctgccccggcctctcccctctggcacacagtatcccaaccatgggtttagtgtccaccagacttaaaggacccaggaccttctcaccacacggaatatgcagccttacgcgtccttgcccagggcctttctgaattttagaagctgccaccagcccagggcaggatcagggaggcagggattgggggggcagggggaggtgtggggagacccccgacaccctgccatcttggcttttccagccccaggacttcttctccccctcaggtgggaggtcaatcccctttactgtgacacagtgaaacagatctacccgtacaacaacagccagcggctcctcaatgtcatcgacatggccatcttcgacttcttgatagcctcagaagtggcggaggtcccagaggacagaaggtaacaggctcccctctcttcaaagaactggaagaagctcaaggggtcgtcactcataaggcaggcatctcaccctgccacgggcctgagtgggcgtcagattggaagctgtatgttcacttcaccaagtgaggggaaaccagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtgg

SEQ ID NO: 10319 - DNA, 5984 bp, Homo sapiens
gtgtgggactgccgctctgcgcggcgagaggtggcctgggaatggccgggccgggggtgggccggagccgctgtggcggcggcggcggctgggggcggtgagcgcggcgtggggctgcccctccccggaggcggcgggggcggccggggccgcgccgcaccgcaccgcgcgggcggccatggagcgagcctagggcccgacaggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacgggacagagtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtcttttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcactctgttgcccaggctggagtgcagtggcacgatcttggcttactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcatctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctcatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaat

SEQ ID NO: 10320 - DNA, 603 bp, Homo sapiens
ggccgcgccgagcgagcgctgggattggccgtcgggcaggcgctacgctaggacggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatg

SEQ ID NO: 10321 - DNA, 2751 bp, Homo sapiens
gcggccgctccggagaggccgagcggggacgggcccgagatggcgcggggacccagcgctccggcggcgggcgccctgcacgcggcccgggcccggggacagccccggagctggtagccgcccggcaccgatggaccttgacccgcgaggcggcgccgcgctcgtgcccagctgcagctagaggggcgcgcgggcagaacgcgctccaggcccgggccggcccgcgcggccatgaagatgatgctggtgcgccggttccgcgtgctcatcctgatggtgttcctggtggcctgcgcgctgcacatcgccctggacctgctgcccaggctggagcgacgcggcgcgcggccctcgggggagcccggctgttcgtgcgcgcagcccgccgccgaggtggccgcgcccggctgggcccaggttcggggccgccccggggagcccccggccgcctcctccgccgccggcgacgcgggctggcccaacaagcacacgctccgcatcctgcaggacttcagctccgacccctcctccaacctctcgtcccactcgctggagaaactgccgcccgcggccgagccggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtcctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtggccatgaagtcggggggcacgcagctgaagctcatcatgaccttccagaattacgggcaagcgctgttcaaacccatgaaacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacaacatctgcttctacggcgagtgttcctactactgctccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtttgggaagtattcgcacgacgagctctccatcctggtgccgctacagcagtgctgcaggatccggaagtccacctacctgcgtctgcagctcctggccaaggaggagtacaagctgagcctgctgatggccgagtctctgcggggggaccaggtggcacccgtgctgtaccagccgcacctggaggccctggaccggcggctccgcgtcgtgctaaaggccgtccgggactgcgtggagaggaacgggctccacagcgtggtggatgacgacctggacactgagcacagagccgcctcggcgaggtagtgtccgccggccgctgcgctgcccgggacggagacagaggcgccggacctcccagcaagcgcatgcgcccgtcgtgaattcagtgaattcagaggcaggacgggatcatccggagtcgggagctgctgccacaggaggcgaggctccccaggtctcataggacacattttgtcagtgtttgaccagaaaagcttgggaaggaagcgctgtctgtgctcacggacagaggcggccggcgccggaggcattccatcctttctgtagggaaaggagcctttatttactattttgtatttatatttgatgaataagtatataaacagagacgtgtacacagatgccaatcacctaccaaaccaaacacgaggaccgccctccctggttctgggggcccctcaaggccaagctcacccctcaagtgctctcacactcgggacctaattcaagtaaaaaccctttctccttcctggggcctcggctcctggagggctggagggtctcgtctgaggacgggaggaggctctcgctggacgtctggcctgtgcgctggtggacggatgcctacgtggttttggaggacccgatgaccaggcgtcctgcgagtccgcccgctggcctgcagcacccacctcggacttggctgtggacggttggtgcaagtgcatcctgcagggctggctgtgcgcagctgtgggctgacctttgcagagttttgtggaatagtttgcaatgtcataaaagtgcaataaaggtacagcagatgtg

SEQ ID NO: 10322 - DNA, 4636 bp, Homo sapiens
atcaggtcacgtgaggccggtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 10323 - DNA, 4435 bp, Homo sapiens
ttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggccgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 10324 - DNA, 785 bp, Homo sapiens
tccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttatttagacttgtctgcattaaggaggaaacagcaaccagggctacagctttgtcttcactgcacttcccccgagtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaat

SEQ ID NO: 10325 - DNA, 4623 bp, Homo sapiens
gtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 10326 - DNA, 4669 bp, Homo sapiens
ttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 10327 - DNA, 868 bp, Homo sapiens
cctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggccgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacg

SEQ ID NO: 10328 - DNA, 4326 bp, Homo sapiens
atgcccaggctttctggcaagtcagtgcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcaca

SEQ ID NO: 10329 - DNA, 4417 bp, Homo sapiens
atcaggtcacgtgaggccggtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 10330 - DNA, 4519 bp, Homo sapiens
atcaggtcacgtgaggccggtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 10331 - DNA, 5609 bp, Homo sapiens
aaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 10332 - DNA, 5751 bp, Homo sapiens
ccgaggggactggctccgccacgccccgcccctggctcccccgggagggcggctcaggggcggggacgggggcgtggtcccgccgtataagaacggagggggcggcggcgggacggctcactcggtgccgctgcctaggggctgtagaggtcgcgccgctcctgctggggcctgcccacgccaaggacctgcctctgtcgcctcctcttctattgcccagtttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaactttccaaccttggagataactctgaaggacatcgtccagaccgtccgcagtcggctggaggaggcaggcatcaaagtgcacgacgtccggctgaatggctccgcagctggccacgttttggtcaaagacaatggcttgggctgcaaagacctggacctaatcttccatgtggctcttccaacagaggcagaatttcagctggttagagatgtggttctgtgttcccttctgaacttcctgccagagggtgtgaacaagctcaaaatcagtccagtcactctgaaggaggcatatgtgcagaagctagtgaaggtttgcacggacactgaccgctggagcctgatctccctctccaacaagaacgggaagaacgtggagctgaagtttgtcgactccattcggcgtcagtttgagttcagtgtggactctttccaaatcatcctggattctttgcttttcttctatgactgttccaataatcccatctctgagcacttccaccccaccgtgattggggagagcatgtacggggactttgaggaagcttttgaccatctgcagaacagactgatcgccaccaagaacccagaagaaatcagaggcgggggacttctcaagtacagcaaccttcttgtgcgggacttcaggcccacagaccaggaagaaatcaaaactctagagcgctacatgtgctccaggttcttcatcgacttcccggacatccttgaacagcagaggaagttggagacttaccttcaaaaccacttcgctgaagaagagagaagcaagtacgactacctcatgatccttcgcagggtggtgaacgagagcaccgtgtgtctcatggggcatgaacgcaggcagactctgaacctcatctccctcctggccttgcgtgtgctggcggaacaaaacatcatccccagtgccaccaacgtcacctgttactaccagccggccccttacgtcagtgatggcaacttcagcaactactacgttgcccatcctccagtcacctacagccagccttaccctacctggctgccctgtaactaaccttgagacctgagggtttccacagtgggaaccccaatagggctagggctctcaggtaggggagcctccttctagatgtaggcatttggcttttaaaggggaactcagctctgattctgcttttttttttttttttcctttgtgtacccattggaatgggtctacagtgtatcatgagccaaccctcaaaggacccgtattacagtgccacgttggaaaacgctacaggaagcatgacctatccacatctttccaagatagacactaacatgtcatgtcccaaacattagcacgtgggggttgagctctgtgcagtaatcgagattgggagaatttgggcagcgcgtgagaagtgctaagctacttgttttctcacttgagcccgggtaggctgtgttggccctcacttgggattctcagcagttacatgaaagttgtgctgataatctcttctcttgtaccaattttagtcaggcagaaaatggtaaacatgagggtgctcttgtgacttaatttttgttcaagggactaaattgcttatgtttattccctgtcagcggagtggagaatgtcattcatcaataaaccaaagccaatagctggagaattgagatctggttgaaagtggtttatggtttacatgctgtactatcctgaggaattgcgagatattgctgaggggaaaaaaaaatgaccttttcttgaaatgtaacttgaaaacaaaataaaatgtggaacataatgtttaattagaattgtggtggtggtagtggaaggggataattgtaaataggaaacatgaatgttcatttttttctttaaagaattcttattaaatggctccctgccttttttttcttttttcctcatcagctctttcatggctgaattttgttttattcttcctaagactgaggattgtgctgagtccagagtcattgtggtaactgacatgagggtcttcccatgttttaactggaaacccactttggtcacattccaagtatgacacagctgttcttctggagtactttagctattttttgtttttgttcttttcgttttttttttttccaaaaatagtgacttccttctccaggtgtgtttgacagcaactcaattcaggaatttcggtagaactgagtgacctgtggaactgctttagaatctaacctgctgtcttcgtgctctgtgtgaaggggaagctggggggttagcatgaagtctggccttgtgtgcattggagcttccaaggcactttgaaatcattccagtatatttgggaagaattgagtgaatgagaatgctcttccttattctggtagatttgacttgtttataattctgcactttagaagaaaaacagtgttaatctgtagttgaaagaaagcttagtagatgagagagttctaggctactgtggctttttccagtagatttagatgagattatgtgttttgaaatgttttgtgggatcccttagaaagcatcacttcagggcagagacactcaatattgccagccagcttgggttctaaagtgatttaatcaaattcatgctcctgatcttttttttcccccttcctttggctatgaaaacccaaagcccggagtgattgttttctccttgctttaagcagtgaagttatcctaatgcaaaagagcttagtagaaaatgagtggtttacctttttttctaaaagtatattttcaagtttattctggaatgtgatgtcttggtcctcttaaaagcagatcagccatgactgaaactcaaggcttagctggtatctatgttgtgctacattaggtgactagaagccacttcttagtgtaatcagctcctgtttccctgtgagccttagttatattttaattcagtggctttgagtcaaggccggttctaattgaggggacccagtgtgcttcagtgttaagagtggggcaatgaagagtgaaccccaatgaagagtgatcccaactttggaaactatctggtcattcatgaccttaaaaagctgccatggtggtcaaatggcatgtgtttgcacaaaaatgaccgatgtgtttaaccaaagctttgaaatgtgatgaagccaccaacataagcacttgcctaacagaaatcagtatttcttctacttagaaggcttggggcccagggtaatgaggcaccagatgaagataagatctgcatcaaggaattaaatttccagtttgtccttggggttctttctgcttatgttttttcccccccatctggtaatagtcctcttctgagaatgaaaggaggcacagaagttgcgagaaagacccagtccccagtctttgccaccattgcaccatggttgtctcggagtcccttcacctgacctttttagtcagctcagatctttttgtagtttgagaatagacctattcaagagctatcagggttaaaagctgcactgaccaaagctgtacttttaaaacacaacccctgggctagtgatgtctctacttgctctatgagccttttgccagcctcagaataggcgaggtaaccttgaatttcagggccctggaaactctagctgaaacctgcctttcctaatgctcacacaagcaccaggtaccctgagcttatactgagtccagtggttcctattttatgtgtgtgtgtatgtgtgtgtgttgagtaacatgaaacttggcagtagcagagagcactgaagttcacatgcaagttctaatctaaagttaagcagtctcttatttgtttcgggactctgatttgactctttttctgatgctttcggcatgtctgcagcctgttctcctagcctgctgcttggagtcaggttgagcatcagtgagatgaagacagtaccttttcctctcacattggcagaatagcacgcactagatgcctgaccttgagctctagtctcccctttaaatcttaccttggcagtaacacattattcctcattcaataatttcaatgctgaaactgaactctattactaatgccttccaatcagagttcctgatggggatgcctgtgggatggcccacacctgggggacctggcagatggggtgagttgggtaaggaagatgatgcttagttcctgatagatgctacagatgtagtttggcatttcagtttttgtccagtttgattttcactggggtttgagtcacagcaagctgtgtatgaacttgtgttttgtggtgacacattaataatcaaattgctaaaaccctgaatctgcttattcttcagcttcacctctgcactaaccccttacccttatggtacgtcaggattttaactagtactgctttgttgactttgggaaatggtgccactcaaaagcaacttcctaacttgaggaataactcctttgtagtttactttctggtactggttggtgccttgtattgggatacagctatattcttagctcaaatgtcctctttttgagagcaaagtagttatccaatggtgagacgagaccctgacgctcatagaggccattccttcctgggtgtcggaccagggctctgtgtcagggaaaaccttctgggtggactttgtaagaatccagtttccaaggttagattcacatccttaatcttgcagagactagaatttcacagctcgctttggaacatattccaattcaaccagttaaaatcagaggaccaagtcgtgggggaggggggcggtgttgaggagaggtatttttaaagatctggcaacttttcaggattatttgtggagaactctaaggttaagatcaggaaataaaagactgtgtgtgtgtgtgtgtgtgcgtgtgtgtgttcaagtgcctaaatcttgtttacctatcactttaaaaaaataattgaagtgtaagctaaataaaatgcttggagttttgcctgggctagtgagagttggtgcaaattcttgtgtgtgtttgcataggaaggtgagatgaccatctactaaagaggaagtagctaaatacagatctgtgggtgtttttaaaaaaactcaacctatctggtgttttattttaatggataaaaatgtaatttttctaaggtagcaacttatttccaaattaatatagatgaaaaatagataccaattagactaaattgaaagctttttgttctatatttgcatagcctttgaaatatttcttagtgcctaggaggtctggggattcctctttcgtggtggtcactaaccttacttgatgcagataaaatcacttgtcaatgcaaaatgtgttagaacttgataaagctttgagtttgagaaataaaggtatatttaaaatttaaataaaa

SEQ ID NO: 10333 - DNA, 2739 bp, Homo sapiens
tcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 10334 - DNA, 2681 bp, Homo sapiens
ggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 10335 - DNA, 2843 bp, Homo sapiens
tccccgcccctcggcccagcctgccaatcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttg

SEQ ID NO: 10336 - DNA, 2625 bp, Homo sapiens
agagacccggcaggccggggcggaggttgaggcagctaaactccaggtggacgcctacatcgcctttcgcggtgttgctaagccgaacttttaattttagtttgacttttgggttccagagacgggtatttccggacactggcaagaattttgccttgcgtgtcttcgaaggcggttttcttggtgtccatattgcataaaggcttgtcgctcctctgtggagatgacggttgtacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaag

SEQ ID NO: 10337 - DNA, 2399 bp, Homo sapiens
gcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagacacaagagcactgaatcaaaagaattga

SEQ ID NO: 10338 - DNA, 2062 bp, Homo sapiens
aatcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatattttt

SEQ ID NO: 10339 - DNA, 1983 bp, Homo sapiens
agccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctc

SEQ ID NO: 10340 - DNA, 2079 bp, Homo sapiens
agccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctc

SEQ ID NO: 10341 - DNA, 2257 bp, Homo sapiens
atgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaaggccgggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctc

SEQ ID NO: 10342 - DNA, 1218 bp, Homo sapiens
gcgcgccggggccgcctctccttccgccggtgccgcggcgcctcatggaagccccggaggcggcggaggggggcctgcagcgcggggcccggagggcagccggcgcccgaagccagggtgcacttccgagtggcgaggttcatcatggaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatac

SEQ ID NO: 10343 - DNA, 1162 bp, Homo sapiens
gcgcgccggggccgcctctccttccgccggtgccgcggcgcctcatggaagccccggaggcggcggaggggggcctgcagcgcggggcccggagggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatac

SEQ ID NO: 10344 - DNA, 1158 bp, Homo sapiens
gcgcgccggggccgcctctccttccgccggtgccgcggcgcctcatggaagccccggaggcggcggaggggggcctgcagcgcggggcccggagggcagccggcgcccgaagccagggtgcacttccgagtggcgaggttcatcatggaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatac

SEQ ID NO: 10345 - DNA, 1303 bp, Homo sapiens
ggcggggccggacgcggccgggtggggcggcacgcccgccgcgagcacctccagttctgccggcttctgcgcgccggggccgcctctccttccgccggtgccgcggcgcctcatggaagccccggaggcggcggaggggggcctgcagcgcggggcccggagggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaataggga

SEQ ID NO: 10346 - DNA, 1282 bp, Homo sapiens
ggacgcggccgggtggggcggcacgcccgccgcgagcacctccagttctgccggcttctgcgcgccggggccgcctctccttccgccggtgccgcggcgcctcatggaagccccggagggcggaggggggcctgcagcgcggggcccggagggcccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtc

SEQ ID NO: 10347 - DNA, 508 bp, Homo sapiens
gcggaggggggcctgcagcgcggggcccggagggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagcc

SEQ ID NO: 10348 - DNA, 593 bp, Homo sapiens
ggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatc

SEQ ID NO: 10349 - DNA, 573 bp, Homo sapiens
caggtactttaacccaagcggtgagcccctggaattggactcccgcttctgggaactccgggacagcatcgtgcagtgtgagcttctcatgctgagagttctgcgcttccaggtctccttccagcatccacacaagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctc

SEQ ID NO: 10350 - DNA, 5471 bp, Homo sapiens
ccggggtccccttcacccaagtgagccagctcaggctgtctgcaaagccggaggtgcgggcagctccgggcattgcattggtgcggaggcttttatatgccagagaaccctgagtgtgcccctgacatgacaaggagccgtcgtcgttaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttctttaggtggctgcatccttccccagacaagcccaggcggctgtctgtcttgagtgccttgcaagacactttctttgccaagctgcaccgcagccgctccttcagtgacctgccctccctcaggccgagtcccaaggccgtgctagagctctattcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaagctttctaggcagatccaagtgatggagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccgggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagtgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacaggttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcaggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatatattacatcgtcgattgtgtctaataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatatcttcaaataaaagtttgcctgcagaacctggcaaaatgacccattaggagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaaacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgcttttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcatttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagc

SEQ ID NO: 10351 - DNA, 2442 bp, Homo sapiens
cgcaagaatgcatacaaactccagggctgctctctcctggagagggagggaggggatttaaaaacctgcagcaacatgggggaggaggctgtttgtccttctctctctggggaagtaactcgctcaaactgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaaaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgctaacaaaaaataaaaacttgaaacaaaaaaaaaa

SEQ ID NO: 10352 - DNA, 2407 bp, Homo sapiens
acgtctggacttaacttccaggatagctgcaagacccttttgttcctttgccatgagcaggttttaggccgctctgttgggaccatggtgttaccttcgcgattacactggatcagaaacaggccatggagggacaggatccggaggcgccagctcaaccgactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaagatgctaaacaccttgacgatcagaaactaaatggtgctgcctcttggacggagatcactgagggtgaatgagacaactgtgatttaaaagaccgaaagacgttttcccatgtgcttttgtgccatcttgagtgtcagagacagatccctgcaaggcccttcctaccttgcgctaagaaatcagcaaggagtgtcacctaactggatggaggacatttagtgcttctaacttgcagaatttgtcccattcgacccaccccagcatcctcttgaatatttggaaatacttctctccaactctgtgcccatagcaactggcattgttttgcttgtaatgtttctgcatgtggccagcattatagaatgctccaggccagagaatgggattgctcccatgatgccagggcctggtcagggaagtggtgggacttgttccctttgaggcagagct

SEQ ID NO: 10353 - DNA, 3256 bp, Homo sapiens
agtgtgactgctgagactgccggggctgctgcctgctgcttctcgcgcctgtcctctccaagatgcagttttttgatgctgaggagctcctggtcgatgaagaggatgatgtttttggtgaaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaagctttctaggcagatccaagtgatggagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccgggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagtgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacaggttaactgcctaacagctgtcttaatatctggcccttttcatca

SEQ ID NO: 10354 - DNA, 2812 bp, Homo sapiens
agggagggaggggatttaaaaacctgcagcaacatgggggaggaggctgtttgtccttctctctctggggaagtaactcgctcaaactgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaagatgctaaacaccttgacgatcagaaactaaatggtgctgcctcttggacggagatcactgagggtgaatgagacaactgtgatttaaaagaccgaaagacgttttcccatgtgcttttgtgccatcttgagtgtcagagacagatccctgcaaggcccttcctaccttgcgctaagaaatcagcaaggagtgtcacctaactggatggaggacatttagtgcttctaacttgcagaatttgtcccattcgacccaccccagcatcctcttgaatatttggaaatacttctctccaactctgtgcccatagcaactggcattgttttgcttgtaatgtttctgcatgtggccagcattatagaatgctccaggccagagaatgggattgctcccatgatgccagggcctggtcagggaagtggtgggacttgttccctttgaggcagagctccagaggaagcagggctgcttcttgtcatgcccaaggcattcattctttcctcagtcctcagaggaaaaattatatgctgtgagcaggtgcggtggctcatgcctgtaatcccaacactttgggaagcccaggattgctggagcccaagagttcaagaccggtatggtcaacatagggagaccctgtctctgcaataaaaga

SEQ ID NO: 10355 - DNA, 1985 bp, Homo sapiens
cacatgcagcttgagcattcagtcttctgacctgttccacctctacagggcattttatggcttaaggatgacggcctagaagggaagggagagacttactttggattaaatttacaatgggaaagtgcttaagctgctgcaaagaggaccagagcttccaacgatgttctccagaagatcaagttagtacagacgcccagcatcgtggagcctcttctatttcacaaccaagtatatctcttggtcataaaacatcttattcccctgtaacacataaagtcaatgcagccaaagcaagtagaaggttattatctgtatcaagtccatctttctctgaaagaagatattctttatttgttggatttcaaaaaagaaatgcttccccttactggcaacaaagtagagctaactttgattctgaagaagacacaggcttcactgatataaaatcttcctcagaccattgtggtagctttatttcccgcagaagacgtttctcatcccgtaaactaagtatagtttcctattacaagagtgccattttttttgatcctcaagcaagtggccagaatgtgtttaatctaaatgaaatcgaaatcttttctaaaacttcaagtaatactgatgctaaaaaacatataaccatctctgctcctgaatataacactaaaaattttaagaattttgaaacaaacactacttctccagcctttgggaacactattgatacagcctcctatcaacaaagcacatcatccttcttttctcttgcaagtgatatttcctctcccgatcaacaaaatggaattgccaatgatattcaacaaaggggccaattatgtaaagatttaaaagatttccttcatcctcgtcctgaaagttacagcacaggtcattctccaatcatgattccacagcatccctctcaaagtggaactttcccattcctccataaagctggattttcttcatcttataaaaattctggttgctttatcccacctcaaagcgaattaacttcaggcctgtttgaagatgaagactttgctgtcttgtttcaagatgaagacagatcttcacctattgaaattcctaaaataaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggagctgtagtctggaagataaagagcctttggtaccgcaagccctgtcatctgtgagtgtggcacagtgaaggcctggagagtcatgacctaggccctgtgaagtcaagtatttttaccaagtaaaaagattggcaataaaacatttccacatagt

SEQ ID NO: 10356 - DNA, 1381 bp, Homo sapiens
gaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaa

SEQ ID NO: 10357 - DNA, 1932 bp, Homo sapiens
tacttcatcaatttttcttttctttttatggactcttttctgttggcaaaaaaaacctgttatttcttgatcttttggcaccattttcgcacttaataatggcgtaatttctcttctatttgttttctatttgcccatctgttcttttttctccttttcctgccttcttttggaccaaaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaatgaattctcatgaatattttattgtttcaatggagacttcgtaagacaaaataatttcattaatgtggatgaaaaatggaaaactcagcaaaggacatgaacaagttgttggcagaagaggaaaaacaaacaaatgtagtattgtaactggtaatcaaaagatgtgaataaaattacaataaaatactgttttaccatcaaa

SEQ ID NO: 10358 - DNA, 724 bp, Homo sapiens
agttacagctttgccaaggtcaatggttgtcactgtccctgagtttctacctttcagataatttttactcatcaaggaatagaaacaaatgtattggaaaggagcaagtgtgacatagtctatgtcctgaacctgaagatcaagtcagtatcagctgccatcttcctcttggaatagactgaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagagga

SEQ ID NO: 10359 - DNA, 1426 bp, Homo sapiens
atgttaactccacatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaatgaattctcatgaatattttattgtttcaatggagacttcgtaagacaaaataatttcattaatgtggatgaaaaatggaaaactcagcaaaggacatgaacaagttgttggcagaagaggaaaaacaaacaaatgtagtattgtaactggtaatcaaaagatgtgaataaaattacaataaaatactgttttaccatc

SEQ ID NO: 10360 - DNA, 582 bp, Homo sapiens
agttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagagacttcgtaagacaaaataatttcattaatgtggatgaaaaatggaaaactcagcaaaggacatgaacaagttgttggcagaagaggaaaaacaaacaaatgtagtattgtaactggtaatcaaaagatgtgaataaaattacaataaaat

SEQ ID NO: 10361 - DNA, 830 bp, Homo sapiens
acatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttgg

SEQ ID NO: 10362 - DNA, 3138 bp, Homo sapiens
tgttatcatagtccataaaatcggtctttttagttgccacaattataagaagttgcatacaattacaagagtaaaacagaattataagacagcacgttaggtttaagatttatggccgggtgcggcggctcacgcactttgggagcccgaggcgggcggatcgcactttgagagaccaggagagcgggacccagtctctacaaaataaaaataaaaataaaatgtggggagagcgtgacgttttccaggtacagaggggaggtccaggcagaagcgcaggtagaaagtgtgaatatgctgagcgtattccgggagcagcaagttaagccggtgtgaccggagggaaatggaggcctggctgccggacggtgagggtgactgcgcgagcgtccgcccaagaagtctccctgccttcccgcctttcccctgtcttgggccccttcttgctttcctttcgcgctctgtgctgactccgcccctccggcggcgcccgtggccccgcccctgagggaaacagacaaggggcggggccggcgcggtcatctctctgcgccttcccgcagggcgccgagcacctggcgccgcctgcctgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgggggttgaaggcccagaagccggactctgtgacccgggtcggggggtgtactggaggggcggctacgtccaggctgggtgagaagagaggcagtggggcccaggaggctggaggaagccttagggttcagactggggtgcacgtagtcgagagctcagggtttgggcaaggggatacctgccggggttcagccttgagggtgggtttaccgggttcacgaatctctctctctccttacccccgcccgcccgcccgcctgcctgctcccggtgacttctgctggccgcaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttatca

SEQ ID NO: 10363 - DNA, 2251 bp, Homo sapiens
gacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtt

SEQ ID NO: 10364 - DNA, 2139 bp, Homo sapiens
tgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtt

SEQ ID NO: 10365 - DNA, 1008 bp, Homo sapiens
agacaaggggcggggccggcgcggtcatctctctgcgccttcccgcagggcgccgagcacctggcgccgcctgcctgacgtcacggtcactgacagcgtgagcccgcggcggctgctgccatggtggctggcggccgggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtg

SEQ ID NO: 10366 - DNA, 3063 bp, Homo sapiens
aaaccatgggggcggaagaggtgctgggcaggaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagacagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgc

SEQ ID NO: 10367 - DNA, 1106 bp, Homo sapiens
gcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaat

SEQ ID NO: 10368 - DNA, 5654 bp, Homo sapiens
ggccgggcgggccgcggcagggagtggctgccggaccgaccggaccgcgaggccgctgggcggcggtcggctcctgctgcccctgtgccgagaccccgcgcacctggccaggcccctggccccaacatggcccgtcgctctcagagctcctcgcagggggacaacccactggcacccgggtacctgccgcctcactacaaagagtactaccgcctggcggtggatgcactggccgagggtggctcggaggcctacagccgcttcctcgctaccgagggggcaccagacttcctgtgccctgaagagctggaacatgtgagccgacaccttcggcctccgcagtatgttacccgagagccacctgaaggcagccttctcgacgtggacatggatggctcctcgggtacatactggccagtgaactcagaccaggccgtgcctgagcttgatttgggctggcctctgaccttcggcttccagggcaccgaggtgaccaccttggtgcagccaccgccccccgacagccccagtatcaaggatgaggcccgcaggatgatccgttccgcccagcaggtggtggccgtggtgatggacatgttcactgatgtggacctgctcagcgaagtgctggaggccgcggcccgtcgggtcccagtctacatcctgctggatgagatgaacgcgcagcacttcctggacatggccgacaagtgccgtgtcaacctgcagcacgtggatttcctgcgcgtacggactgtggcgggccccacctactactgccgcactgggaagtccttcaagggccacgtcaaggagaagttcctgctggtggactgtgccgtggtgatgagtgggagctacagcttcatgtggtcctttgagaagatccaccgcagcctggcgcacgtgttccaaggagagctggtctccagcttcgacgaggagttccgcatcctcttcgcgcagtccgagccgcttgtgccctcggccgcggccctggcccgcatggacgcctatgccctggctccgtatgccggggccgggcctctcgtgggcgtccctggggtcggggcgccaacccccttctccttccctaaacgagcgcacctcctgttcccgccaccccgggaagagggcctgggcttcccctccttcctcgacccggaccgccacttcctgtcggccttccgccgggaggagccgccgcggatgccggggggcgcgctggaaccgcacgcggggctgcggccgctctcgcggcgcctggaggccgaggccgggccggctggggagctcgcgggcgcgcggggcttcttccaggcgcggcacctggagatggacgccttcaagcggcacagcttcgcgaccgagggcgcgggcgccgtggagaacttcgcggccgcgcggcaggtgtcgcggcagacgttcctcagccacggcgacgacttccgcttccagaccagccacttccaccgtgaccagctctaccagcagcagtaccagtgggacccgcagctcacgccggcgcgcccgcaaggcctgttcgagaagcttcgcgggggccgcgcgggtttcgcggacccggatgacttcaccctgggcgccgggccccgcttcccggagctcggacccgacgggcaccagcggctggactacgtgccgtccagcgcgtcccgcgaggtgcgccacggctcggaccccgccttcgcgcccggaccccgcggcctggagcccagcggagccccgcgccccaacctgacccagcgcttcccatgccaggccgcggcgaggccgggcccagaccccgctcccgaggcggagccggagcgcaggggcgggcccgaggggcgggcagggctgcggcgctggcgtttggcctcctacttgagcggctgccacggcgaggatgggggcgacgacggcctaccggcgcccatggaagcggaggcttacgaagacgacgtgctggctcccgggggccgggcacctgccggcgacctgctcccctcggccttccgcgtcccagcagccttccccaccaaggtcccggtgccaggcccgggcagcggcggcaacggcccagagcgcgagggcccggaggagcctggcctggccaagcaggactcattccgctcgcgcctgaaccccctggtccagcgcagctccaggctgcgctcctcgctcatcttcagcacgtcacaggccgagggcgcggccggggctgcggcggccactgagaaggtgcagctgctgcacaaggagcagacggtcagcgagacgctggggcccggcggagaggccgtgcgctccgcggcttccaccaaggtggcggagctgctggagaagtacaagggcccagcccgtgatcccggcggcggcgcgggcgccatcaccgttgccagccacagcaaggccgtcgtgtcccaggcgtggcgggaagaggtggcggccccaggtgccgtggggggcgagcgccgcagcctcgagagctgcctgctggacctgcgcgactcctttgcacagcagctgcaccaggaggcggagcggcagccgggagccgcgtcgctcaccgcggcgcagctgctcgacacactgggccggagcggctccgaccgcctgccttcccgcttcctctctgcccagagccactcaacgtccccgcaagggctggacagccctctgccgctggaagggtccggagcgcaccaggtgctccataatgagtcaaaagggagccccacctcggcttaccctgagcggaaggggagccccacgcctgggttttccactcgaagaggaagtccaactacaggatttatcgagcagaaggggagccccacctcagcctaccccgagcgcaggggtagtccggtgccccccgtgccggagcgcaggagcagtccggtgccccccgtgccggagcgcaggggcagcctcacccttaccatctccggggagtccccgaaggccgggcccgcggaggaggggccgagcggccccatggaagtcctgcgcaaaggctccttgcgtcttaggcagctgctgagccccaagggcgagcggcgcatggaggatgagggtggcttcccagtgccgcaggagaacggccaacccgagagcccgcggcgtctgtcactgggccagggtgacagcacggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagaaagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatctgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagacctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcgcctctgtgcctcaattcctcattctctgggcccttctcctcctcagggcctcctgttctcagggcctcccccctccccgctccctccctctctcaaggtctcctccttccctcccccccccccccccccgtctcccccctcccccgcctgggcttcacttcctttcctacttggattctcctgctcgctgcctcccagcatcttttttggaggcccgtctcttgctgtggggaagactgggctggctgcgggcagtttgcaaggggtgggtggggcaggggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcattggcctttgcagcacagtaaaacatggtccagacaacctgtggccccggcctcatgagcaccccctgcacaggcccggcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta

SEQ ID NO: 10369 - DNA, 5404 bp, Homo sapiens
ttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggtagaaaggccagagtgggtttgtggagtcgccactgcgggaccagcacgaaagctgcttgtctgctttggcggagctgagctgtgtatgggatccaggaggctggggtgatttattttatgggattcctggagcgcagggctggtgaatccatgacaaggtccgggagcagcagaccaaaaccacagcagcctcctattaagtgtaacaaatagttaagcaaactcgggctacaaacaaagactttgctacctccctcctccacaacccccaagtaattagccttctggagctggctcttagctgaggctcctgctacctcctgctccacccgccccttcctaggttacaagtaaatcattgtcaagggccagccaggggaaggtttcaattaaggttctgttctgctgcctttgtttctcccctgctgttgtaggcacttacagctgcgttgttatgaaaggagggaatagccctttgtgtctttgatctaattaaacctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtctttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagcagaacaagataaacatgggttaagacatttaggagaacctgctgtatctaacccagttggattttctttcatgcttaacacagtagtgaaaatagaaggtaggccgggcacagtggctcatgcctgtaatcccagcactttgggaggctgaggcaggtagatcacctgaagttaggagttcgagaccagcctggccaacatggcgaaaccctgtctctaccacaaatacagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgtgtagacaagtgggagggaagaatagaatggcactgtccagctctgggctagccagatcaactcccccacccgtcttcttcctctgtcccagaatggaaaatgatgtatggtcagtcacgctgaagtatagcagcgactgtgttaagagagagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcac

SEQ ID NO: 10370 - DNA, 1519 bp, Homo sapiens
catttttctaagagagcgtcgtggtgccagtgcctgcaggttctgtgaggaagcggcatcaggggtccctcaggttcagggatcgcctctaacttcccaggacagccaaccatggagcccgtgggcaggaagcgcagcaggaaggctgccaaagctcagttggaagctcaagttacggccgcccagggggccacgaaagaaggttcagggatcgcctctaacttcccaggacagccaaccatggagcccgtgggcaggaagcgcagcaggaaggctgccaaagctcagttggaagctcaagttagggccgccccggcgaagaagcacacaggaaaggatccagtccgtgatgaatgtgaggaaagaaacccttttacagaaacaagggaggaagatgtaactgatgagcatggggaaagagaaccttttgctgaaaaagatgaacacacggggattcataccatgaagctagaacatattgcagctgacattaaaaagggccttgctgcaaaaagagaaatgataaaaatagataaagcagcttacaggaaaaccaagaacacaattgaacgtgctttgaaaaaaaaacaactaaaaaggcagaaacgtgattatagacatactcggaagttgctgaatgtccttaaagaatacatcgcagagaagcagaaagatgatgaagcagaagaagcagaagccgcagcagcagcagcagaagccgcagcagcagcagaagccgcagcagcagcagcagaagtaatagtagtagaagacgaagaggaggaagagaaggaggaggaggaggagaaagaagaggaggaagaagaaggagaagaagaaggaggaggagaagaaggagaagaaggaggaggaggaggagaaggagaagaaacagaagaagaggaagaggaagaagaagaagaggaagaggaagaacaaattaaagcatttcaagaaaaacagaagaggtggcaacaacctacaggtgttaggagctggaggctgagagagatgaagccgctacttgagcaattactaaaggctgccaaggacactaaagacaattattgcatcatttcttccagtgaagaaagtgaacttgataactagccgtgtttttaaaaagaatcgtgtcagaactcttttggaagagttggcacttcattgtctcttcaacctctgttattctgatgactgaagaaagaacttgaacctatgttatatgatacgagcacaacttgagctacagtaaactacatgacagtgttttgataattgttgtataaatcggtatagctcctctgtcacttgtctgttaaatgccagacctcgtttctatgatctgttgaatgaatcctagacacttctgtgagaaggcagggattgcacagttatgtacatggtcaattaaattttaacattaaagataatttagatttcagttcacctctgtggatctgtatcagtttcaaaaacgtagaaagcacgggcatagaaaagtacatttttctctaataaa

SEQ ID NO: 10371 - DNA, 1544 bp, Homo sapiens
gaggaagcggcatcaggggtccctcaggtgaagcgctcgcggtggggaggcaggaagtcgagcatgcggccctctcgcaaccagggtgtgaagcgcaggttcagggatcgcctctaacttcccaggacagccaaccatggagcccgtgggcaggaagcgcagcaggaaggctgccaaagctcagttggaagctcaagttacggccgcccagggggccacgaaagaaggttcagggatcgcctctaacttcccaggacagccaaccatggagcccgtgggcaggaagcgcagcaggaaggctgccaaagctcagttggaagctcaagttagggccgccccggcgaagaagcacacaggaaaggatccagtccgtgatgaatgtgaggaaagaaacccttttacagaaacaagggaggaagatgtaactgatgagcatggggaaagagaaccttttgctgaaaaagatgaacacacggggattcataccatgaagctagaacatattgcagctgacattaaaaagggccttgctgcaaaaagagaaatgataaaaatagataaagcagcttacaggaaaaccaagaacacaattgaacgtgctttgaaaaaaaaacaactaaaaaggcagaaacgtgattatagacatactcggaagttgctgaatgtccttaaagaatacatcgcagagaagcagaaagatgatgaagcagaagaagcagaagccgcagcagcagcagcagaagccgcagcagcagcagaagccgcagcagcagcagcagaagtaatagtagtagaagacgaagaggaggaagagaaggaggaggaggaggagaaagaagaggaggaagaagaaggagaagaagaaggaggaggagaagaaggagaagaaggaggaggaggaggagaaggagaagaaacagaagaagaggaagaggaagaagaagaagaggaagaggaagaacaaattaaagcatttcaagaaaaacagaagaggtggcaacaacctacaggtgttaggagctggaggctgagagagatgaagccgctacttgagcaattactaaaggctgccaaggacactaaagacaattattgcatcatttcttccagtgaagaaagtgaacttgataactagccgtgtttttaaaaagaatcgtgtcagaactcttttggaagagttggcacttcattgtctcttcaacctctgttattctgatgactgaagaaagaacttgaacctatgttatatgatacgagcacaacttgagctacagtaaactacatgacagtgttttgataattgttgtataaatcggtatagctcctctgtcacttgtctgttaaatgccagacctcgtttctatgatctgttgaatgaatcctagacacttctgtgagaaggcagggattgcacagttatgtacatggtcaattaaattttaacattaaagataatttagatttcagttcacctctgtggatctgtatcagtttcaaaaacgtagaaagcacgggcatagaaaagtacatttttctctaataaa

SEQ ID NO: 10372 - DNA, 1340 bp, Homo sapiens
aggaagtcctgcctgcagctctcacgagaactgaggacccgttttctttacttttctttttttttgtttttttgttttgttttttttgggacggagtctggctcttgctgcctaggctgcagtgcagtggtgtgatctgggctcactgcaacctccgcctcctgggttcaagcaattctcctgcctcagcttcctgagaggacccgttttctaagaggtcctagtggtgccgctgcctgcaggttctttgagggcgccacatcaggggtccctcaggttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagaggatcttactgcaaaaagaaaaaggatgaaaatggataaaacttgcagcaaaacaaagaacaaaagtaaacatgctttgagaaaaaagcaacttaaaaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgatttggcctctgtggatttgtatcagttccaaaaatgtagaaagcacaggcatagaaaagtacatttttctctaataaa

SEQ ID NO: 10373 - DNA, 2047 bp, Homo sapiens
gcagaggccgtggagttcaggtgtgaggggcagctgtgagctttgcagccagccccggggacgggctggacgggccaggacaggaggggacactggcatcttttccgtcccttcctgctcccacatgagacccagggcgggccagccccacccttcttgaacctgtgatcccaatggctttcctttccgatgccaggtttccttagcttccttagtgtgtctttgcgctcaccaggttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagttggtgcaaataatttcaaaaactatcctgtacatattggcgtctctagtgaacaacatattttacttgattgttctctaagtaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgatttggcctctgtggatttgtatcagttccaaaaatgtagaaagcacaggcatagaaaagtacatttttctctaataaaagaagacaatatctgctgggtgtggtggctcacgcctgtaatcccagcactttgggaggccgaggggagtggatcacttgaggtcaggagtttgagaccagcctggccaacatggtgaaaccccatctctgctaaaaataccaaaattacccgggcgtggtggcacgcacgtgtagttccagctactcaggaagctgaggcaggaggatctcttgaacccgggagttggaggttgcagtaagccaagattgtgccactgcactccagcctgggcgacagagcaagactctttctcagaaaacaagaagaagaagacaaaagctatcttatctgtgcgttcttttgtatttactcattaggataaagaggcaattccaatgaaagtaggacttcaaaaaatagatatactctatggccatatcaaaattattaaaagcaccttactgtctgtgttcttaaaaaaaattatactgctgtaaatgattaaggcaactgagcaagatatattaatatcagtgctgagccactggtttgtgggtatgtcatttccacagacatcaaaatgctatttagtttgttttggtccatcattcaatgatacctccccttagaattgaatgaaagcattttgttaacatttatgtatgcttacaattatttcacatctgtggcaaggtaaattttgtagagtgctttgtttatccagtttaatattcgtggattatgtggaagtttatatggacatctaaaaacttgaatgatg

SEQ ID NO: 10374 - DNA, 1064 bp, Homo sapiens
gttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagaggatcttactgcaaaaagaaaaaggatgaaaatggataaaacttgcagcaaaacaaagaacaaaagtaaacatgctttgagaaaaaagcaacttaaaaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgatttggcctctgtggatttgtatcagttccaaaaatgtagaaagcacaggcatagaaaagtacatttttctctaataaa

SEQ ID NO: 10375 - DNA, 3361 bp, Homo sapiens
gaggagcttcgcggtgccagcctctgcaggtcctctgagggagcaacatcagggctccctcaggttcagaggtcgcctctagcttcccaggccagtcagccacggagcccgtgggcaggaagggcagcaggatggctgccaaggaccagttggaggttcaagttatggccgcccaggaaatggagcttgcaggaaaggatccagtaagtcatgagcatgaggaaagaaaacctgttacagagacaaaggagggagatgtaactgatgagcatggggaaagaggatcttttgctgaaacagatgaacacacgggggttgataccaaggagctagaagatattgcagctgacattaaagagcatcttgctgcaaagagaaaaaggattgaaaagattgcaaaagcttgcagcgaaataaagaacagaattaaaaatgttttgagaacaacacaactaaaaaggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaaggtctgttctatttggtaacacaatacgttcttataaaatacaacacatgcataaaaatagaagacaatctgcttgtttctgaatgtatggaaagacattttggttatacattttaaattacttaccattttcactttgaatgtgttgttccagatttaacataagtagtaaataacataaaataacataaaacagtatttttaggattcatgaatagttttgtaggagttatttagaacaggaaaaggtaaattggaaattttacctagaaatatacatcttgtgtataaaaattgataccttatgaacacattaatgaagactttattttcagtttttaggagatcagcgacaaatctttagtggaaggcagaaagtccataagtcctttctggatgtcttttttacttgtgttgtttcaagagttttagttaaataggaagtaggcaaatgtaactactgagtatctcttttgttttctgctgtaatgtaggagtgttttatggcatattcactttcaaaattattagtgactagtaatggttttacatgacaatttgtaatcataagagatggttcagatgtataacagaatgggaaagccagcagattattaacatgttgtgaattgtgaattatctgctgtcgtacagcacattagcaaattgtcatcggacaatgaccgcttcttcatgtagatgtatattatttaggaagcaatggaattcccttctgggaggtaagatattctttttaataaccttgtggaaagacatgttcatatgtcactcctctacactaactgagatgtgttaaataaactgggaaaagagtttgaaaatagaattttcaagcaactcaaagattatctatacacaaaacggttatttatatagaagtcacaagtagagaacatgttgctataatgttccccagaaaccatttattaattggtatgaacatgagactagaaaagttttcctgtcaatgttaatgctacatgttaccacttagggtaggaacttcggtatcatcttggactcttctgagtccattatctttcacatacagttttcatgaggcaagttttactctgcaatggtccttaaatttcttttttttaaattgccactgaggcaaccctagttcaagaactcattcttccttgcttgtactattaaactcttttctgagttctctcttctcttctgagccacccttcattgatcagaaatactatcttcctaaaactcttcccttcctaaaatgcttctagcccttcactcttcccagcctatcagtggtatccacatgtcagttcttagatattcagagactctcccctttacatgaccccctcttaggcttgttttactgccttctgtctttcttcccgcctctccaggttgacagccttctctgaacgacctctccattactctcatgctttgctcatgctcttccctcacaatgcttttaaagtccttttttttttttgatcgattgaaatcttttgccaactaagtggacatcagtctccatttttggctacatgtccgagtgagttgctcttccacagcagttacataagttttgtattattttttttattcgtgcatatttgctcatgtcacaggaatatggaagagattgtgtattcattttttacatcttcctcagcattaacataccactttttagggagtaggaactgttgaactatttgttgagagaatagtatatatttcaaacatagttatgttttctctaacttgatgaggtcatgtcacagaccattttatcccttcagtggaaaccatgttatgtcgactattagtgataacaaatgggtcactatctggtgaaaaaatatggtatttcatgatctaagactaccagtctttttctgtttttgctccatcttgaccataacatattcatcaaaccattttcttcaagcaaagtacatgactgttggacctgctataataatatttcactaaaatctggcattaaaaattttaagtatttggagctccatgtactgattacagtttttaaatttgaaataaatgaccagcatcctttgaatattaaaagctgtttccttttgacatttaatttactctctttaaaatgtgagttgtaaagtgatggtttgtcagtgaactagactttttgttttagagtgtgaggacttggaagagtataatgaaagccctctttttggtgaagagagtcaacttaaaaaataaattgccatgttccaaaataatattgtggtaattgtaagtagtgcatattttatcttaaaaactcaggattgatgtaagcactggaatattttatttgtagaaatgtgtatcgcaattacttaaatttatttttttgaaacagctgcagcaagagttggcacttattcagatgtatcttcaacctctgttattctggtgactgacaaaagaacttgaacctatgttatatgatacatgcataacttgagctacactaaaccacatgacagtgtttagttaattcttgtataaattagtatatctcttctattattagtctgtttgttaaatgccagaccacgtttctatgatctgttgaatgaaccctagacagttctgtgagaaagcagcaattgcacagttacatacacagtcaattaaattttaacattaaagataatttagtttta

SEQ ID NO: 10376 - DNA, 1122 bp, Homo sapiens
ctgggccgaccaatcagcgaggagcgcgggcagccggggcggctgctgctctcgtgagaacagaggacccaggccctcggaggagcttcgcggtgccagcctctgcaggtcctctgagggagcaacatcagggctccctcaggttcagaggtcgcctctagcttcccaggccagtcagccacggagcccgtgggcaggaagggcagcaggatggctgccaaggaccagttggaggttcaagttatggccgcccaggaaatggagcttgcaggaaaggatccagtaagtcatgagcatgaggaaagaaaacctgttacagagacaaaggagggagatgtaactgatgagcatggggaaagaggatcttttgctgaaacagatgaacacacgggggttgataccaaggagctagaagatattgcagctgacattaaagagcatcttgctgcaaagagaaaaaggattgaaaagattgcaaaagcttgcagcgaaataaagaacagaattaaaaatgttttgagaacaacacaactaaaaaggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaagctgcagcaagagttggcacttattcagatgtatcttcaacctctgttattctggtgactgacaaaagaacttgaacctatgttatatgatacatgcataacttgagctacactaaaccacatgacagtgtttagttaattcttgtataaattagtatatctcttctattattagtctgtttgttaaatgccagaccacgtttctatgatctgttgaatgaaccctagacagttctgtgagaaagcagcaattgcacagttacatacacagtcaattaaattttaacattaaagataatttagttttaggtttggcctctgtggatctgtatcagttccaaaatgtggaaagcacgggcatggaaaagtacatttttctctaataaa

SEQ ID NO: 10377 - DNA, 472 bp, Homo sapiens
gagatgtaactgatgagcatggggaaagaggatcttttgctgaaacagatgaacacacgggggttgataccaaggagctagaagatattgcagctgacattaaagagcatcttgctgcaaagagaaaaaggattgaaaagattgcaaaagcttgcagcgaaataaagaacagaattaaaaatgttttgagaacaacacaactaaaaaggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaaggtctgttctatttggtaacacaatacgttcttataaaatacaacacatgcataaaaatagaagacaa

SEQ ID NO: 10378 - DNA, 5858 bp, Homo sapiens
actgggccgaccaatcagcgaggagcgcgggcagccggggcggctgctgctctcgtgagaacagaggacccaggccctcggaggagcttcgcggtgccagcctctgcaggtcctctgagggagcaacatcagggctccctcaggttcagaggtcgcctctagcttcccaggccagtcagccacggagcccgtgggcaggaagggcagcaggatggctgccaaggaccagttggaggttcaagttatggccgcccaggaaatggagcttgcaggaaaggatccagtaagtcatgagcatgaggaaagaaaacctgttacagagacaaaggagggagatgtaactgatgagcatggggaaagaggatcttttgctgaaacagatgaacacacgggggttgataccaaggagctagaagatattgcaggtatgttttacgagctatttgtggtttatgaaaattgttttcaaccatacaacccttacagtaggttatatgaattagtggatgacaagactgtcttaaatgccttcttctcatatatagcatttaatgtaatctgtttaataatttttcttacttacttttttaattgttgatgtggaatgtgagaatgcttctaataatggtgaagcaagaggggtggcttttctttcatacacgtggaaatttaattgtttgggggatattagaggacattggaggagaaacagctctattcgttcctttcagtgtacacacattaagtcatatatcaggtttttttttagcttttactttatgtttgggggtacatgtgcaggttcgttatatagataaattgcgtgtcacaggggtttggtatacagattattttgtcacccagattataagcatcgtacctgatgggtggttttccatcctcaccttcctcctaccctccaacctcaagtaggcccaggtgtgtgttgttcacctcttcctgtccgtatgtactcagtttttaatatgagtttttcatcttcctaatttagctattgtcacaactttctaattttgttttctttaaagtaccagagaaaattgaattctctaaaatgatgattttctattattattccagtaacaagctgtgtagtagaaaaggaaagacaacttttctacccagtgagaagcatacaattggatccaaaaactcataaactttatattgccatgtgaaatattagttgcactgttatgggaccatattttcaaaaaagtttgagaaaatttctgtagagattatgaagacaatactcttatttttaaaaagcttactttagttttcagctcttctatagcgataattcatataagcagtatatttggaaagctttgctctgcttggtggtgacaaagtgccggttttgtctaatacaatgagcattatagatggatactgtatgtaaaaaaatttgtattatggtgcagctcttttatgattgctcaaaactattctcagcaattgatggtagatctctcatgtgaaaccatgtttaggaaagcattccttgcagtattacagttttctgaaacactgcactgtggataaaaatgtcatataaaaagctctcagaaaatatttcaaatgtgttttgaatgtatttatctatttaaacctaaatgtttacacccatggacattgcttcttttattaaaatatagttaatagcatcaactattgattaaaaatactttctttattgtgtattaagttatttctacccttttgatggtcttattaaatcagatacttttttgtgctttacataatgagttgtgacagtatttcacggaaacatgtcctttgaattgtaggacattttataaatgtagaaattaaagtctgtggctgggcacggttgctcacacctgtaatcccagcactttgggaggccgaggtgggtggatcacgaggtcaggagatcaagaccatcctggctaacacggtgaaaccccgtctccactaaaaatataaaaattagccgggcgtggtggcgggcgcctgtagtcccagctactcgggaggctaaggcaggagaatggcgtgaacccgggaggcggaggctgcagtgagccaagatcgtgccacagcactccagcctgggtgacagagcgagactctgtctcaaaaaaaaaaaaaaagaaattaaagtctgtgtttgtaaccctttctgcacacttaaaaaatagaaacttttaattatttgctttttttcattatctgtcaattaagtgatttgctgttataccaactgaaattggaatactaatacctgaaaggttttacataaagtaagtaaatcttgctttttgaaatgatctttgcattttacattttaaatgtccttctgatattgctgaaccatcaagtcccatattgattttaatatatgcaaagaaactacttttcaacatgaacatttaatgcatattcatttactatctagctgacattaaagagcatcttgctgcaaagagaaaaaggattgaaaagattgcaaaagcttgcagcgaaataaagaacagaattaaaaatgttttgagaacaacacaactaaaaaggtatgattgttggcttttttgaataatgatatttatatcatttctttgtattcattggtgcaaataatttccagaactatcctgtacatattggtgtctctagggaacaacatattttacttgattgttccctaaacaggtaagtttctttagttttataacctcaatttaacagaattgagagatattacctagaagccaatgaagatgacctctttttgccttccagataaaaagtcttcctgtaaaattaatgtttatccatttctagaaatacggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaaggtctgttctatttggtaacacaatacgttcttataaaatacaacacatgcataaaaatagaagacaatctgcttgtttctgaatgtatggaaagacattttggttatacattttaaattacttaccattttcactttgaatgtgttgttccagatttaacataagtagtaaataacataaaataacataaaacagtatttttaggattcatgaatagttttgtaggagttatttagaacaggaaaaggtaaattggaaattttacctagaaatatacatcttgtgtataaaaattgataccttatgaacacattaatgaagactttattttcagtttttaggagatcagcgacaaatctttagtggaaggcagaaagtccataagtcctttctggatgtcttttttacttgtgttgtttcaagagttttagttaaataggaagtaggcaaatgtaactactgagtatctcttttgttttctgctgtaatgtaggagtgttttatggcatattcactttcaaaattattagtgactagtaatggttttacatgacaatttgtaatcataagagatggttcagatgtataacagaatgggaaagccagcagattattaacatgttgtgaattgtgaattatctgctgtcgtacagcacattagcaaattgtcatcggacaatgaccgcttcttcatgtagatgtatattatttaggaagcaatggaattcccttctgggaggtaagatattctttttaataaccttgtggaaagacatgttcatatgtcactcctctacactaactgagatgtgttaaataaactgggaaaagagtttgaaaatagaattttcaagcaactcaaagattatctatacacaaaacggttatttatatagaagtcacaagtagagaacatgttgctataatgttccccagaaaccatttattaattggtatgaacatgagactagaaaagttttcctgtcaatgttaatgctacatgttaccacttagggtaggaacttcggtatcatcttggactcttctgagtccattatctttcacatacagttttcatgaggcaagttttactctgcaatggtccttaaatttcttttttttaaattgccactgaggcaaccctagttcaagaactcattcttccttgcttgtactattaaactcttttctgagttctctcttctcttctgagccacccttcattgatcagaaatactatcttcctaaaactcttcccttcctaaaatgcttctagcccttcactcttcccagcctatcagtggtatccacatgtcagttcttagatattcagagactctcccctttacatgaccccctcttaggcttgttttactgccttctgtctttcttcccgcctctccaggttgacagccttctctgaacgacctctccattactctcatgctttgctcatgctcttccctcacaatgcttttaaagtccttttttttttttgatcgattgaaatcttttgccaactaagtggacatcagtctccatttttggctacatgtccgagtgagttgctcttccacagcagttacataagttttgtattattttttttattcgtgcatatttgctcatgtcacaggaatatggaagagattgtgtattcattttttacatcttcctcagcattaacataccactttttagggagtaggaactgttgaactatttgttgagagaatagtatatatttcaaacatagttatgttttctctaacttgatgaggtcatgtcacagaccattttatcccttcagtggaaaccatgttatgtcgactattagtgataacaaatgggtcactatctggtgaaaaaatatggtatttcatgatctaagactaccagtctttttctgtttttgctccatcttgaccataacatattcatcaaaccattttcttcaagcaaagtacatgactgttggacctgctataataatatttcactaaaatctggcattaaaaattttaagtatttggagctccatgtactgattacagtttttaaatttgaaataaatgaccagcatcctttgaatattaaaagctgtttccttttgacatttaatttactctctttaaaatgtgagttgtaaagtgatggtttgtcagtgaactagactttttgttttagagtgtgaggacttggaagagtataatgaaagccctctttttggtgaagagagtcaacttaaaaaataaattgccatgttccaaaataatattgtggtaattgtaagtagtgcatattttatcttaaaaactcaggattgatgtaagcactggaatattttatttgtagaaatgtgtatcgcaattacttaaatttatttttttgaaacagctgcagcaagagttggcacttattcagatgtatcttcaacctctgttattctggtgactgacaaaagaacttgaacctatgttatatgatacatgcataacttgagctacactaaaccacatgacagtgtttagttaattcttgtataaattagtatatctcttctattattagtctgtttgttaaatgccagaccacgtttctatgatctgttgaatgaaccctagacagttctgtgagaaagcagcaattgcacagttacatacacagtcaattaaattttaacattaaagataatttagttttaggtttggcctctgtggatctgtatcagttccaaaatgtggaaagcacgggcatggaaaagtacatttttctctaataaaagaagacaaaccctt

SEQ ID NO: 10379 - DNA, 2342 bp, Homo sapiens
atccgggcccttccagaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgctgacagacctaccgtggggaagaaagagaagctctgaagatggatcatggccgtgactgcatgtcaaggagaatctccatgatgacacggaggcctacgtcgagatagagtaaatatggtccaattaaaaggtgacccgacaatcaacccctgaaaaaggcggtcataaaacccccaggagacgaagatgatggcacgtcgtgaccccaaacctggggcaaagagactggtgagagcccagaccctccagaagcagcggagggccccagttgggccaagggctcccccgcccgatgaagaagatcccaggctcaagtgcaaaaactgtgaggcctttggccacacggccagaagtaccaggtgccccatgaagtgctggaaggcagccctggttccaccgaactttggggaaaaggaagggaaggaaaacctgaaaccatggaagccccaggttgaagcgaaccctgggcccttgaacaaggataagggagagaaggaagagagaccaaggccacaagacccgcagaggaaggctctcctccacatattttccaggaaacctccagagaagccgctgccaaatcaaaaaggatccacggaatcttctgattatctgagggttgcaagcgggccaatgccggtccacacaaccagtaagaggccgcgtgtggaccctgtcctctctgatcgctcagctaccgaaatgtctgacaggggctccgtcttagcttcactgtctcccctcagaaaagccagtctgagctcctcctcaagtcttggaccaaaggaaagacagacaggggctgcggccgacatccctcagactgcagtcaggcaccagggccccgagcctctcctcgtggtgaagccgacacacagcagccctgcgggtggctgtcgagaagttccccaggctgcctccaaaacccacggcctgctccaggccgtcagcccccaggcacaagacaaacgtcctgcggtgacctcacagccctgcccaccagccgccacacacagcttgggcctaggctccaatctcagcttcgggccaggagccaagagatctgccccggctccgattcaggcttgcctgaacttccccaagaaaccgagactgggtcccttccagatccccgaaagcgccatccagggaggtgagctgggggccccggagaatctccaacctccgccagccgcaaccgaacttggaccacgtacgtcaccccagacaggcacgaggacacccgcccaggtgcttagcggcgaccggcagcctccgcacagcagaccttgcctgcctactgcccaggcctgcaccatgtcccatcacccagcggccagccatgatggggcccagcctctcagagtgctctttcggagactggaaaacggacgctggagctccagcctgctgacggccccctcatttcactctcctgagaagccgggagccttcctcgctcagagccctcatgtctcagagaagtctgagggtccctgtgttcgtgtcccaccaagcgtcctctatgaggaccttcaggttccctcctcctcagaggacagcgattctgacctggagtgagactgcaggtggcaggggctccttggcctccagctcccgtgacttggaggggactgtgggactgaggagcacagagcagagagcagactctgtgcggtgactccgaagctccccggctgtggcccttctgtggatgtgggagcccaggccaggcagggagcagatgcagggactctgccacgttgaattctggtgagggacattgtagttcgcatggttctctggaaacgcgccaggaaaagcttccgtgccagtgattcgttgcctcagaaactgcatgacgcgcaggagtcagacttccgctgggacgtcaataggaaacgggggaattactgtgtatttgctctctagacgactgaataagggaaaagttagggaaccctgagaggtgcagcccttccgctgtgccccgccctgagagcagtgtttcggacgctgggaagcgcgctgtgcaaagcgctctcggggtctttcctcagcctcgaaaagtgggctctggaatccctttgtaaataggtgtgttgaatttgttttgaagtgaataaaattctcaaaaagatga

SEQ ID NO: 10380 - DNA, 592 bp, Homo sapiens
agaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgctgacagacctaccgtggggaagaaagagaagctctgaagatggatcatggccgtgactgcatgtcaaggagaatctccatgatgacacggaggcctacgtcgagatagagtaaatatggtccaattaaaaggttagggtacgttccacgtcaggtgaccagaggcagtataaaaggcagcctggaaagcagaggtccctctctgccccttcctccgtcttcctggatgctgcatcgcttccagcggggctgctccagcacctgcccatctcagcgccagccggggaaagaaagtagacgtgtaatttcaggtgacccgacaatcaacccctgaaaaaggcggtcataaaacccccaggagacgaagatgatggcacgtcgtgaccccaaacctggggcaaagagactg

SEQ ID NO: 10381 - DNA, 2513 bp, Homo sapiens
agctccagtcaggccccatccgggcccttccagaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgctgacagacctaccgtggggaagaaagagaagctctgaagatggatcatggccgtgactgcatgtcaaggagaatctccatgatgacacggaggcctacgtcgagatagagtaaatatggtccaattaaaaggtgaccagaggcagtataaaaggcagcctggaaagcagaggtccctctctgccccttcctccgtcttcctggatgctgcatcgcttccagcggggctgctccagcacctgcccatctcagcgccagccggggaaagaaagtagacgtgtaatttcaggtgacccgacaatcaacccctgaaaaaggcggtcataaaacccccaggagacgaagatgatggcacgtcgtgaccccaaacctggggcaaagagactggtgagagcccagaccctccagaagcagcggagggccccagttgggccaagggctcccccgcccgatgaagaagatcccaggctcaagtgcaaaaactgtgaggcctttggccacacggccagaagtaccaggtgccccatgaagtgctggaaggcagccctggttccaccgaactttggggaaaaggaagggaaggaaaacctgaaaccatggaagccccaggttgaagcgaaccctgggcccttgaacaaggataagggagagaaggaagagagaccaaggccacaagacccgcagaggaaggctctcctccacatattttccaggaaacctccagagaagccgctgccaaatcaaaaaggatccacggaatcttctgattatctgagggttgcaagcgggccaatgccggtccacacaaccagtaagaggccgcgtgtggaccctgtcctctctgatcgctcagctaccgaaatgtctgacaggggctccgtcttagcttcactgtctcccctcagaaaagccagtctgagctcctcctcaagtcttggaccaaaggaaagacagacaggggctgcggccgacatccctcagactgcagtcaggcaccagggccccgagcctctcctcgtggtgaagccgacacacagcagccctgcgggtggctgtcgagaagttccccaggctgcctccaaaacccacggcctgctccaggccgtcagcccccaggcacaagacaaacgtcctgcggtgacctcacagccctgcccaccagccgccacacacagcttgggcctaggctccaatctcagcttcgggccaggagccaagagatctgccccggctccgattcaggcttgcctgaacttccccaagaaaccgagactgggtcccttccagatccccgaaagcgccatccagggaggtgagctgggggccccggagaatctccaacctccgccagccgcaaccgaacttggaccacgtacgtcaccccagacaggcacgaggacacccgcccaggtgcttagcggcgaccggcagcctccgcacagcagaccttgcctgcctactgcccaggcctgcaccatgtcccatcacccagcggccagccatgatggggcccagcctctcagagtgctctttcggagactggaaaacggacgctggagctccagcctgctgacggccccctcatttcactctcctgagaagccgggagccttcctcgctcagagccctcatgtctcagagaagtctgagggtccctgtgttcgtgtcccaccaagcgtcctctatgaggaccttcaggttccctcctcctcagaggacagcgattctgacctggagtgagactgcaggtggcaggggctccttggcctccagctcccgtgacttggaggggactgtgggactgaggagcacagagcagagagcagactctgtgcggtgactccgaagctccccggctgtggcccttctgtggatgtgggagcccaggccaggcagggagcagatgcagggactctgccacgttgaattctggtgagggacattgtagttcgcatggttctctggaaacgcgccaggaaaagcttccgtgccagtgattcgttgcctcagaaactgcatgacgcgcaggagtcagacttccgctgggacgtcaataggaaacgggggaattactgtgtatttgctctctagacgactgaataagggaaaagttagggaaccctgagaggtgcagcccttccgctgtgccccgccctgagagcagtgtttcggacgctgggaagcgcgctgtgcaaagcgctctcggggtctttcctcagcctcgaaaagtgggctctggaatccctttgtaaataggtgtgttgaatttgttttgaagtgaataaaattctcaaaaaga

SEQ ID NO: 10382 - DNA, 1698 bp, Homo sapiens
gtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggtaaattctcctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaaga

SEQ ID NO: 10383 - DNA, 2894 bp, Homo sapiens
aggatgcagcgcgctggcgggaggtttggagcagatggataccgtatcgacgtggggcctccggtatgttgccgctgcgttgaggtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 10384 - DNA, 3008 bp, Homo sapiens
agcgcgctggcgggaggtttggagcagatggataccgtatcgacgtggggcctccggtatgttgccgctgcgttgagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 10385 - DNA, 2712 bp, Homo sapiens
cgggaggtttggagcagatggataccgtatcgacgtggggcctccggtatgttgccgctgcgttgagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagaga

SEQ ID NO: 10386 - DNA, 4585 bp, Homo sapiens
actgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaa

SEQ ID NO: 10387 - DNA, 4504 bp, Homo sapiens
gagcccccggagaggcgggagccgggtgttggcgttttggttctttttgttcattgagcgcaggcagctatgtcttcttcaaaggagaggagcaaagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcaccta

SEQ ID NO: 10388 - DNA, 591 bp, Homo sapiens
cttccctccattctttttgtggacgccaggccatatcttcaaagcccgtgagagatttttcagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgctt

SEQ ID NO: 10389 - DNA, 5219 bp, Homo sapiens
gtcagagcggcgtcgggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctga

SEQ ID NO: 10390 - DNA, 5008 bp, Homo sapiens
ggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 10391 - DNA, 5102 bp, Homo sapiens
ggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 10392 - DNA, 5185 bp, Homo sapiens
gtctctcgaggccccgctcccctgcggcctaatctctaagtccgggccgcggtcggcgttctcctctggggctccgcgccccgaaccttggcttcctcatctgccctgagatgggataatccccacaggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 10393 - DNA, 2554 bp, Homo sapiens
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgaaaccactgttgctgcgattgccccggatatgccagaggaacctgatgtccctgctgatggccgttcggccatcgctgccggaaagtgggctcctctctgtgctgcagattgcccagcaggacctagcccctgacccagatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggaggggttagagggattggaggatgcccccccagttgagctacagcttcttcacgaatgtagtcccagccagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataat

SEQ ID NO: 10394 - DNA, 3309 bp, Homo sapiens
tgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtactccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacgaatatatgcctttggatattaaattaatgcttgatgataaaagaatcaaacttttttttttttgagatggagtctcgctctgtcacccagactggagtgcagtggtgtgatcactgctcagtgcaacctctgcctcccaggatcaagcaattctgactcagcctcccaagtagctgggattacaggcgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcagttgcgtgaattttttttaagaaacaacccagtgaagagttctaccatagcaaggcctaatgttagctttagctttagaaaataacagtttgtgaacttacttccctatatttgcagctgtatctcacactatgatttacaataaaattgtaaagattgacaatagacttaagaaataacattttaaaatctattttatacttaccatttattattctgttattttagtctccatatgttcattacatacataatcttatttaatcttcacaccaaaactgtattcttatgaatatacgctaaaagattaagtaaaatgcccaagggtataaacaaaagcaacatgaaagtggaagccgtatctgtcatttattttatttccagaagcctagcacagtgtccagcatatggtagatacttgtagtgtttgaataaatgaaaccagcattagagctttatatactttctcttaaggacttgaaaagattaggaatctacgcatacactgagagagaaaaaagtgagagga

SEQ ID NO: 10395 - DNA, 4713 bp, Homo sapiens
gccgcgggggcggatcttgttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatttcttctgtggttgaagtaggggacaggtacaggtagaatatttgaagctctgctgccttcatttctgaaacatcatatcacattcactctggacacagggcaccttataaactgaaattagcctagaata

SEQ ID NO: 10396 - DNA, 4749 bp, Homo sapiens
tcttgttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaggtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatt

SEQ ID NO: 10397 - DNA, 3690 bp, Homo sapiens
gagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagtatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtg

SEQ ID NO: 10398 - DNA, 1061 bp, Homo sapiens
ggaagtttgtggcggaggtgaggccgaggtgactgcagagcggctcgcgagagtctccctctgttgccaggctggagtgcagtggcgcgatctcggctcactgcaacctccgcctcctgagttcaagtgattctcctgcctcagcctcacaagtagctgggactacagggttttggactgataaagcaatggaagccactgaagagctttaagatgaggatggcatggagggaagataagtcacataatcagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagtgagtaatatagtgtagaaataaagatcattttt

SEQ ID NO: 10399 - DNA, 1683 bp, Homo sapiens
gtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaaga

SEQ ID NO: 10400 - DNA, 906 bp, Homo sapiens
agcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataatt

SEQ ID NO: 10401 - DNA, 7111 bp, Homo sapiens
ggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggaatgaggcaaagtagcctaaagaaagattggttcttatcagaagaagaatttaaattatggaacagactttatagattaagggacagtgatgaaattaaagagataacattgcctcaagttcagttttcttctttacaaaatgaggaaaacaaaccagctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaa

SEQ ID NO: 10402 - DNA, 2354 bp, Homo sapiens
gtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcatttttcccctgttcttacttagcaggtcgtatcttgatataatatttcttgtttgaaaaactgaatatatgttctaattaatatattataggcattctctttggaaaggctgtacgagattattcatgtggcaaatggagagacactggtagtatagagtgacagaaactcagtgttggggaaaattaaacataccctaccaacccagagaatgttctccataaagtttag

SEQ ID NO: 10403 - DNA, 2524 bp, Homo sapiens
gcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctc

SEQ ID NO: 10404 - DNA, 2378 bp, Homo sapiens
acggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctc

SEQ ID NO: 10405 - DNA, 2033 bp, Homo sapiens
ctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaagaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagtgcaggtttgatccagccagtatagaactagctctgtag

SEQ ID NO: 10406 - DNA, 2312 bp, Homo sapiens
ctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccgcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatg

SEQ ID NO: 10407 - DNA, 802 bp, Homo sapiens
gcgcaagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatggctcttggacaagtccgagcagtacaacacactgggagggaatgccctctccttttaaagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcag

SEQ ID NO: 10408 - DNA, 2138 bp, Homo sapiens
agctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatggctcttggacaagtccgagcagtacaacacactgggagggaatgccctctccttttaaagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatg

SEQ ID NO: 10409 - DNA, 1478 bp, Homo sapiens
gagtacccgccaacaagcgggaccgagcaggaatccgtatctgggaacaggtgagagaggatgtgtgctgggccttggaggaagggggccgagaccgggccttacttctgtaacgatactgtgaggcatcggaaggccagcctgttgtgtccgttttgaaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 10410 - DNA, 1431 bp, Homo sapiens
agtgtggggagagcgggaactactcgacccacagagccgatcgcggagcggattctgcttttaggagtacccgccaacaagcgggaccgagcaggaatccgtatctgggaacaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 10411 - DNA, 1338 bp, Homo sapiens
tcagcgcggctcatcttcgcccagccaggacacgcaggatcgcgttatctgtccctcccgcgggcacattgggagttgtagtctaattatatatttccgcccttagtgtggggagagcgggaactactcgacccacagagccgatcgcggagcggattctgcttttaggagtacccgccaacaagcgggaccgagcaggaatccgtatctgggaacagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttc

SEQ ID NO: 10412 - DNA, 2176 bp, Homo sapiens
aatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagta

SEQ ID NO: 10413 - DNA, 1393 bp, Homo sapiens
tcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaa

SEQ ID NO: 10414 - DNA, 1472 bp, Homo sapiens
gcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatccc

SEQ ID NO: 10415 - DNA, 1596 bp, Homo sapiens
cggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcat

SEQ ID NO: 10416 - DNA, 1909 bp, Homo sapiens
cttggcagctgaacctgcctgtgagcaggtcgtgtatttctcggcttcccttatccaactttgcatttctatttctagcatattgggttgattcttttgaagctgcctctgtgcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaaga

SEQ ID NO: 10417 - DNA, 2013 bp, Homo sapiens
atctggggcaaggggcgcggcgagcagggccgacgcctgggtgttcccgtccccctttcctcgagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttg

SEQ ID NO: 10418 - DNA, 1761 bp, Homo sapiens
aattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttcccttagcggccagtgggttctggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgct

SEQ ID NO: 10419 - DNA, 1952 bp, Homo sapiens
aaaaacggtggcaacacgctgggtttgctttacaacgcttgggaagctttgttgtttgcaataaattttaatacttgtctgtttcggtctgcactgcctttatgagctgtaacactcacagggtaggtttgcagcttcactcctgaagccagtaagacaacgaacccactgggagaaacaaacaactccagacgcgccgacttaagagctgtaatactcgctgtgacggtctgcagcttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcacc

SEQ ID NO: 10420 - DNA, 1840 bp, Homo sapiens
cgcgcaaactcgcggcggacgcagccagcacccgcagccagcacccgcacactcccacccataccccggcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaa

SEQ ID NO: 10421 - DNA, 1445 bp, Homo sapiens
gaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 10422 - DNA, 2834 bp, Homo sapiens
gtagacacccttgcgcttcaggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttg

SEQ ID NO: 10423 - DNA, 2419 bp, Homo sapiens
aacgccgctgaaggtatccgggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccatccatgagtatatattcccaacccttattacagagaattacaactctgccaccctcccctaccccctgcacttcaccctccttcaatgacgaatgcattgttcaagtgtgagtgatcactaaatagaatttttacctctccagtgcccatcttttccccacagtgtctaggacagttctgtctgttctgtgacaccaggatgctgtatatttgatatatgtcttttta

SEQ ID NO: 10424 - DNA, 1645 bp, Homo sapiens
cgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaa

SEQ ID NO: 10425 - DNA, 4367 bp, Homo sapiens
aggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccatccatgagtatatattcccaacccttattacagagaattacaactctgccaccctcccctaccccctgcacttcaccctccttcaatgacgaatgcattgttcaagtgtgagtgatcactaaatagaatttttacctctccagtgcccatcttttccccacagtgtctaggacagttctgtctgttctgtgacaccaggatgctgtatatttgatatatgtctttttattttcatgactgaatttctacttcatcacctaattttaaggggcagagggaaaaaaagtcaaatgagacattgtcggcatggagattaaacattgtaggaaaaaagtataccatttttgttagaactttctgatggctttactaagatgtcaggttttgtttgaggactgaatttgacatatatgcaagatatttatttactgctgctgccttgggtctccaggttctacctaggaggtatttgctgttccattgcagcatagggaaactgttcaagcacacaatgtgaatgttgagatcatgtgcagagaggccagtaccaaaacttcagtatctggcccaatggcaagaggctactgttaggtttgcatttgggcagttagaacctcacagataccagctcccaagttgctagtccatcagtgtaaactgaacacaattctctcttgctttctctctctctactccctcacacatttggaccttgtcacttggtgtttaagcaccttgcctatcaacaaaatctgatgagcagccccatggactctcctgtaataaggaacttgctctactattttattcttttaatgttttagtatttgatattggactcaaatgaaagggatctcattctgtggctgaaaaatcagacttcatatgttgaagagagcaaacttggggactcaactcagaagacatgtgttgcctgaaacctgcatataataatttttgatttgatttagtaagtgtggatttttcttaatctacagatttggggtttggggtttagatcatgagaacaccgtttataccttcacagccaatgatttatttttagtcttgaaatatttctccatatctgtttttgtgtcacctgtgggttttatcctaggggttgggatcctgattttaacattttgtacttgtccaaaaaagagttcaaatgctgggtttgttcccccagcctcggccaaggggttctcagaagattctaaccaaagctggagataggtctgctcattttccttctgcccagaagtggatgttggccaggaaaattacaccttgtgtcttctctgatgctccaaccagggacctctccagattactatctagcacagactagtgctacatctgcctaggtatgggctttctctggcagcaggggtctctctagggaggctgagagacccatgggtctcccttcaggggaagtgttcaggggagttcaaactgaacacttctctccagctctattcctatcttcctaatctaatggctctacaagatagtcatttccagtgctacagatgcaccagggcaccacctctttttttttctaggtagaccttgttctgtagctgctgtgaagaagctgcagccctgaactcaggtcatactcaggaacagcagcaggggtgtgggtggggtttgagggaaggtactctgaattcaccttcatgtttaacctgttccatctgacttgggtttcttcattatattgttccctcccactcaccttcacttctgtattacaacaatatagactttactctaaa

SEQ ID NO: 10426 - DNA, 1978 bp, Homo sapiens
gcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggaactttgcaacagttttcctatagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctactt

SEQ ID NO: 10427 - DNA, 1544 bp, Homo sapiens
atacaaagcaggcttgagatgtatccttgcatatttgaaggttctgtggttatgatgagctgaaatgaccactgattaatacagtagctctctaaaataatgaggtttctccactaacggaacctctttatttatcaaacttataataaaatgaggaatctgcttgagatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaag

SEQ ID NO: 10428 - DNA, 4654 bp, Homo sapiens
agaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggcttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccagctgccacacccccgacactcctgctgtccactggccttagctcctgcaagttccccagtgtccgcacctgttcccttccctgacctcaccttcctggggtctgtgactgactggagataaaaataaaagcaattgtgacacctga

SEQ ID NO: 10429 - DNA, 1256 bp, Homo sapiens
ggccctgatgcccggctctggtttcacgcgggcagcgtcagctgcgtcctccgcagcatcttcccaggcccggccctctcctccccccgcgccgatggtacgcgccggctcgcctggcccggctgcagtggatgttgctagaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcc

SEQ ID NO: 10430 - DNA, 2094 bp, Homo sapiens
ctcagtggccctttaggtctaacacagtcttctgggaaccagacctaaatcccattttctgagagccgggctttttgttgctgtttcaatttcacaccaccccctccaccccagtctttccttctctggctgcctcattcaggccttcccagctcaaatcctctcaccaaagctaaacatgtccacgggtggggggcaggggacacatctgagtgtaaatggactcgcatttccaacctgccatggggacgtttccctttgagcctcagtttcctcatctgttcagtgacggaagagactcaactggatgtcttctgaggccccttccactgggtcactctgtgagtctgttctggtttaggggagaggctgagattcctacaggatgaggccagaacagacccttagcctggatcctcttgcccttcctccaccctgaaggcccttcttcttttctgttttctccctctcctcttccctttctgttgcccttctctctcccatctccattctccttgcatcacttccagcgcaacagaaggatcaatcccagtggatgatgcctaggccctgcctctcagtgggccacatgcagctctgtgaccttggatgaatcgctcttcctctgtgatcctcattctcctcattttaaagcaggggtcaaaatgcagctagcaagtctcaggaagattaaatgacataaccttttatttgtaacaatctactatgtgccaggctcttttctggaaccatagagaccctgcccctaccccagggacaatgacagtgacaaccaatggtggacactcctaagaattttctctttcctctgttcctatcccagctccaccatgtgccccagctagctctgacccctctggagcttagttctcttgtctataaaatagagacattcttgtctgcattcctggcttccaagtgcaggtaaggaaggaaccatgaaagttccaggaattgaagagttggtgaggaggaggagttggaaggctccctttccctggtgactatctctctctctgactctactccatagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaaccc

SEQ ID NO: 10431 - DNA, 1950 bp, Homo sapiens
atttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatc

SEQ ID NO: 10432 - DNA, 1055 bp, Homo sapiens
tctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctga

SEQ ID NO: 10433 - DNA, 1441 bp, Homo sapiens
atttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcag

SEQ ID NO: 10434 - DNA, 594 bp, Homo sapiens
acaaccactgtggagcccgggtctgtcaggcacatccccccagaaacagtttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcct

SEQ ID NO: 10435 - DNA, 580 bp, Homo sapiens
agagaacatgtgacaaatctgctgtgtgggggcgagcagggagtggctgacacaaccactgtggagcccgggtctgtcaggcacatccccccagaaacagtgggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgtt

SEQ ID NO: 10436 - DNA, 567 bp, Homo sapiens
tttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagagatggagtcttgctgtgttgcccaggatggtcttgaacttgtggccttaagtgatcctcctggctcagcttcacaaagcgctgggattacagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacag

SEQ ID NO: 10437 - DNA, 1609 bp, Homo sapiens
gggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaagggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttccccgttgtgaatctcagttttgggacggggagc

SEQ ID NO: 10438 - DNA, 1827 bp, Homo sapiens
ccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttc

SEQ ID NO: 10439 - DNA, 1402 bp, Homo sapiens
gatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttc

SEQ ID NO: 10440 - DNA, 2475 bp, Homo sapiens
gaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgagggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggtacgcagccaggatggctggctgggcccctgagggctggagaggcaggggagcagggtggcctgcagcccagagccccagtccccgcctccccacaggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacaggtggatggggcagcctggggcaaggggaggggccagcctgggaccagcagagtggaaaagccagagggaccatgaagcgccaaagctaaggagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttc

SEQ ID NO: 10441 - DNA, 1764 bp, Homo sapiens
gagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttc

SEQ ID NO: 10442 - DNA, 1748 bp, Homo sapiens
cggggaaggggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttca

SEQ ID NO: 10443 - DNA, 750 bp, Homo sapiens
gtccagtcaccgtaaacgccccaagatcatctttgtccctaaaaacttacccccgaccccgctcgtgcccctccccagagtgcggagccttccccagaccgcgcattcctgcagtgtcagaaccgctggcagcggccgcagacgccgggagagcgattgttttactacagacgggcgggagaagggaccggggcggctgcgcggtggcggggcgcgctgccgtcgggtgggccccgggctctggaatgcggggagcagtgtttgacggcgtcgaggagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggagtaagaagtcttaattgccctctcctgcttcagtcgagagccctgtagtccttgtctccttgacatagtgctggtttctgtctataggtttatgggctattactttcattttcgtg

SEQ ID NO: 10444 - DNA, 1053 bp, Homo sapiens
ccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggagtaagaagtcttaattgccctctcctgcttcagtcgagagccctgtagtccttgtctccttgacatagtgctggtttctgtctataggtttatgggctattactttcattttcgtgttgccagcggagcagtgccctggtacttgctgtcatagctctatatatgtccctttacagtcccctgaggagaactttcttaaattgaaaccttagaggaatgaaggttttcctagatacaaaatggaatttcaggagcacagtaaatttcagggtctgtctatcttaagctttctttatatcagtggaaatccagcgagatattagaaataaaggccagaaaaaattaattaaccatgatggatgaatctatgttattggactaatttgcttcaagaaacaccagaattttgaaaatcccgaatttttgacagcccctcaggcctggagagttatctacagatgttaggatatgtccacataagaaagcatctaaactgaactgagagcacagcgggctaccctggacaaagtaaaggtggaa

SEQ ID NO: 10445 - DNA, 2722 bp, Homo sapiens
tgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaaccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgc

SEQ ID NO: 10446 - DNA, 2777 bp, Homo sapiens
gctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 10447 - DNA, 2182 bp, Homo sapiens
gtaatttgtagagacgggggtggggtgggggtcttgctatgttgcccaggctggtctcaaactcctagactcaaacaatcctcctgccttggcctcccaaagtgttgcgatcacaggcatgagcccctgtccctggcccctattatttctctaactggggaaagtcatgtgggaacagatgtagcttgccttggcctctgaccggccctgcctgcgttcctgggtgctctctgctgcttctcatgtgtgccactgtggggactcggccgcccaccccaccccgtggtgttaccttgcgtgtgtagttctgtgagctcagggctatggtctgccagaactagggggcgtggggccccagtaccagcccaaggcctcctctctgcaggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccc

SEQ ID NO: 10448 - DNA, 1551 bp, Homo sapiens
atgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagtttctgccaacaccatgtttgagatggagtggcgtggccggcgggtagcactcaaagccagcaacgggcgctacgtgtgcatgaagaagaatgggcagctggcggctatcagcgattttgtcgggcccccaccccgcccggcctggacagggaaggtggcgggaggggcagcgcagcagacgctctccccgccaggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactga

SEQ ID NO: 10449 - DNA, 1665 bp, Homo sapiens
cagggggttcgtgacgccggctgggtctgggggctgtgggccagccgagccgacccgggcttctgggggaccgcgggggccgtgagcactcagagggcgcatcccaggcccctccggggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagtttctgccaacaccatgtttgagatggagtggcgtggccggcgggtagcactcaaagccagcaacgggcgctacgtgtgcatgaagaagaatgggcagctggcggctatcagcgattttgtcggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactgaggccgcgcccagaccagcctgtcgcgcattaaaaccgtgtctctcccgca

SEQ ID NO: 10450 - DNA, 3188 bp, Homo sapiens
aaagtctggcgcccagcagaggttaggtgtttaaagttaggacctgaatgggttacgttgcgatacacgatcaaacatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatca

SEQ ID NO: 10451 - DNA, 2586 bp, Homo sapiens
catcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagcta

SEQ ID NO: 10452 - DNA, 2344 bp, Homo sapiens
gaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagtaagtttaaaggaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtg

SEQ ID NO: 10453 - DNA, 576 bp, Homo sapiens
gcgcccagcagaggttaggtgtttaaagttaggacctgaatgggttacgttgcgatacacgatcaaacatcgcccttataagctctgtggtatccccgagccccactcctgtatgcagggaaattagtcattctccttggtaaactttcttcaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgat

SEQ ID NO: 10454 - DNA, 2874 bp, Homo sapiens
gcggaagtagcgggcagttggccggaagtggggctgtgaggctcggagtcgccggaggagccagtatctgtgtcgccgccgcccgcggcgtccccggtttggtgttgcggcgcccaccttcgggaggatcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaagtaa

SEQ ID NO: 10455 - DNA, 2799 bp, Homo sapiens
gaacaaaggaatgaaatcttgactgccatccttgcctcgctcactgcacgccagaacctgaggagagaatggcatgccagggcagagaggagtgttggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaa

SEQ ID NO: 10456 - DNA, 1065 bp, Homo sapiens
agcatgaagcgcaccccgactgccgaggaacgagagcgcgaagctaagaaactgaggcttcttgaagagcttgaagacacttggctcccttatctgacccccaaagatgatgaattctatcagcaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaa

SEQ ID NO: 10457 - DNA, 707 bp, Homo sapiens
aagctgtggtggctccacgtttctttagcgggcagtgttttatatatataggttaagattatcaccagctcctcctggcccatgggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccc

SEQ ID NO: 10458 - DNA, 1517 bp, Homo sapiens
tccacgtttctttagcgggcagtggtaaaaagagtatttaagatcggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttgg

SEQ ID NO: 10459 - DNA, 3056 bp, Homo sapiens
gtttcaagagtaaaggagaacaaagtagggtgacctagtctgaaggacaggcgcagaacagtcagtggaacagccagagatagcagcgagagaggtgagaagaggaccaggagtaggtggtagaatggagtggaggaaagtcagcgaatgtaatagtgtcgaaccctgcagggaagttaagaagtggccataccgttgcattcatcatgggaagaatttcagtagaatgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaa

SEQ ID NO: 10460 - DNA, 11766 bp, Homo sapiens
ctacgctcttccagctgtcggacctgggaaattctcctgtgctaaatcccgtggcgctcgcgggtgtcgccgcggtgcatcctgggagttgtagttttttctactcagagggagaatagctccagacgggagcaggacgctgagagaactacatgcaggaggcggggtccagggcgagggatctacgcagcttgcggtggcgaaggcggctttagtggcagcatgaagcgcaccccgactgccgaggaacgagagcgcgaagctaagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgagagattttgctgtttttttccttttgcatggatgagccagcttcactgtcctgggtggggcccaggtggaattagttctcaaagtcctccaggtggagtcagggaatgtgcaacagggttggagaaatcactactttaagtgaatccgaaaggtgagatcacatttgctctaaagaaatggtgatcccagcactttgggaggctgaggcagcagatcactggaggtcaggagttcgagaccagcctggccaacacggtgaaaccccgtctctactgaaaacacaaaaattagctgggtgtggtggtgtgtgcctgtaatcccagctactcgggaggctgaggcaggcaaatcgcttggcccgggaggcggaggttgcagtgagccgagatcatgccactgcactccagcctgggccacggagcgagagaagaaagaaatggtgactttcattgatcatgtgtttgaggatttcatgtgctctccagggaggtttcaggtgggtagaaggaggtgggcaagacccaataaaaaagcagctggtgcgggcaatgacaatgaactcgtatcctgcagggtcaaaggaaggcttgcttctgctgtgaattggagaaggactttcctggaagcacaggcccagaaatcgcacccttctccccatgtgtgcggataagggaccacttccatcagcagcagccccctcctgctttcctgccagtcctccctgtggtcccaggtctcttgagaaaagtgatctaagagatccctttgcaatgaggtgctactgactgccctacctccctcccttcctcccatgaatgtttcttggtgctgaccacagcctcagcaatgaggcaagcctggggacccaagacagatctctgcctcccaggctagtggatgccctgggatatgtagtcaccaaaataggaacttaccccatagtggggaaatagacagtaagcagcaaatcaataacaagagtgttccagatggttgtaagtgccaggaagggaaccaactgggagagggacaagaggagatggtgactgaccaaggggaccttgatcaggctgtggggaagggaggtggttgggaagagcttcccaggaaaggggacggcgggcccaggcaggagagccttgggagggggtgcccaaggaaggaaaagggccctgagcctgaagccgagaagaccaggaggggagaaggggagatgtagggcagagcagacgggagccgctcgggttttattccacacaccccaggaagcatgagagggtttcaagcagcaagggcatggaagtaacttggtgagatatttttatgcattagatcatcgctctatctggattccagagggtctctgagagagcaaacagcttaatccaaaggagcggctttccaactgggaatgtccccctggctgggtgagatctcaagatggcctgcggcccctctagattgcctgcctacagagttcactctaaacagcccctcccctccacaccccagcagatccattcctgacgccctcactggcaggctccagccccacagagctttctagacataaaagagcagggtcatggcatcattggtgacacaattttagtaataagcttcaaaacccatcactccactgaatccagggatgccagaattgagagtccataggacccgtttaacggatcccacattcagtagacggttttttgtatgcttcgagggaaggaaggtattttcaaatgcaacttcttttttttttttcttgctctagttagggctgattttaccactgggcaaattgcatacatttggatccatgccacgctaaaaactgtttattttggagatctgtcagaggcaagcacatggaagacaaggggattctggtttgaaaaggcaattctcatccagacagattcagatggagaggagcggtgtggattaaaatgcgccgaagtggtaatgccgtttatcccgtttgcctttgttactctgtgattaaatggtatttttaattaagtttcattgggagccataggtatcgcggtggtgaaatcaatttgacaaccataaaggggagagacggcacaggcgtgttgtgatgattgcggctgtagggaaagccgggcagcttgcagaggatgggtgggaggaggggaagccggctaagaatgacttcctgcaagacagcaagggcacccctgggccactgctgtgtttgggaggcaggttttgggggttgtcagaaggcattcacctggttctctcgctcacctgagacacccgatagattcctggaaactccaggaaagtatctgaagatctggttctccattctctcttattaacaaggagaaccacaagtgccccccagatcccggctagaaggaccagacagctttccaccccggttcccaggcagccctgctcccatagtcctgtgtcccatcggccccatgctcccaggacagtcctaattcccacctctcagaaccttgtcagccaagttcttcctgctctctggcccaaatcctcctcctacattggaaactgagcctctctgcatcctctgctctttctatcccgctgtcattcatcagattttccaaatctttggattcctgagtggcagaagaggttttctgagtttaagttctgattctgtgtgtgattctcactctaccacctcttcaaacctttgttgtcttatctacaaaatagaatagtagtaatccatcacctaaggttgttgtgaaggttcaataagttaatgcgtatttaaaatgcctcccacagtacctgacatatactgggcttcagtgaggtactagctattattattaaccaagtttcctgtggtaacagttgtagctttgtgactgggccaaatcacttaacccctctgcgctccagtctttgtttctataatggggatgatgataatgcctagctcattggattgttctgtcccctacgatcagccatgttaagtgattcatatcatgtctggtacttaaaaatcacgccacgcatgtacattattatgatgaaaaatatgatccgtgatatcctgaccaaaatattaaagggactaaagatagctgtggcttgttcaagaagaatattgtgtcactatcccatatattatcccatttgctcttcacagcttccatttttcgctaggcggatggcatggaactttttataaatgagatattatgaaaaatgatgttttaggactctcatttctacagtgggagtaggtcacccattgcaattttggatttgcttaaaaaaattcttgccatcaccttctaatggatgatctgtgtacaacaattgtttattgactctgaatgtctaagtaccagggtcagtctatttcaaggggagggaagcattaattaacctccagcattagattcagtgattcttttccaatgatgcagttcatgactttgctcgcatttacttttcatcaatcctgaaagaattgaggtaaaatagttcctctgcacatgtgtgtcaagctaaatggataacagcagatacagatctgtttgcctgtctgcacttgcctttagacaaaattcatcaattttacaaaagccactgactaaacatggcaccaatacaaatgaagcacttctagcaggcggagattccctttgtttctgatctggtaaatgcggtagtttcctgctgagagatgggaagtgctggcctaggacagcaaggtgccctacaggtggggccaaaagggtcaagaccgttctacaggaagtttaggagaagttcaatggttccagatcctgtgtgcttcgggtaattctgaccctcttcattagtgataatggcatgaagctctttcacacagtcttttttttttttctttttttttttcagacagggtctcaccctgtcacgtaggctggagtgcagtggtgagatcacggctcactgcagcctcgacttcatgggctcaagcgattctcctgcctcagcctcctaagtagtcgggatcataggcacttgccaccacatccggctaatttttttgtagagacaggatttcaccacattacacaggctggtttcaaactccgaggctcaagtgatctgcctgcatcggcctcccaaagcgctgagattacaagcgtgagccactacgccttgccctccacacagccttgcttggtgttaaagattaaacaaagaccacaggtgatcactgtcttcgtggtgccagtttcaagggcacccttcttcccttcccagcctccgagagaaggagagagggtccacaagccagatccatccccatccacacaggtaaaaccacgactgtgcagctagcaggtggagataacatttggaaaaaggctttgtaaatgctaaagtcctactcaagtccaagggagagaaattattattattcgttttgtgaaaccaatttagtttggctgggtaatggaagaatttctacatacattcattacttctgatcaggcaagaccagtctgacacaggaacagtctatggctcactcttaaagccacagcaggctgccagggcttggagaaatagaaacctctcttgcacaagaatagtctcaatgaatcatgttaaggcctctttaggtttttcagactccatgcaccctgtggaaactgcctttcttgagtagaggtacgttcagcacttcataaaataatcttggagcctccagacacacggatggaggagcatgatttcatttgtttctttgcaaaactgctgtccccaactgaaaaacctgattatcctttcaaatagggaattcggctttccacgttggaaccagaacagttaaccttcaaacccccaaggcttgcaagagatgaatcagtttctcagacagccaaagccgtggcttataactcatccaacccagaaaactggaccgctggtcaccttccttccccctgcccccaactctgcagacagaggtttcccgttgattatgccttgattagagtcaggagagaagcaaaccaggtatataggattccattatccttccctcctctgctcccaaccagggtcacgctgagagggatctcggtgaacatgtgaacaatcaagccatgtttaccatggacgtttagttttcttttctcaaaatcaaaacagagtttagtaggcagcgtatttcatacatgccccttgatcaatggaatgatctgtcagaagccattaaagcccccattagcttgaatgcattcaaagctaaactattggatcatttaagggctgcagtgattgtttttaatataccgtacattgatttctccctgtgagcagcaacataagtttgaaactaactgtgtatgactaaggctccatttgctgtctccaaccctctgtgagaagcatggtttcacttcgaccagaaatgtctgtgtatagttttcaaagagatgcagaccctgttcgatttcccaagatttagactgggtcgggttgttatttcttttttccctgagctttctcccatttctttgtgcccattaagtgagctgtgcgtgcagaatgggagaggcatccctgccaaggacttcaagtgaaaggcggtgggagaaattgttctgaaagcatgaagcccagctgaggccaaaatcaaagtgaatttgacagccttgggccagcaaaactctgtacccagcagaaaacaatagatgtgtggctgtgtcaggggcatcctcactgggacatagcttggggagctgaaggtaccttggaagggccagatgaggaagctagccaaggccacaggccttcctttgactgccatattgccagctcttcatagtattgactcttcagtcttagccaacacacacttgttgattccttccggaatgtcagactctgctagcaacacaaggtccctgtcctcaaaatcctattcttaatcagcatttctaatttctgccctttgctcattttaatacagagcctgaggataggagagcagcgtggtgaaagaagcaatagttaccacatttgcaaaggcacataccccaaagagaagtttttaatatgtcacacccatattttatagatggggcaatggaagtccagatgggagaagttatttcaggtgaattatagaaactggatttcaagtttctgataagtattgaatttgggaaggctgtgaacattcttgagcccccctcccaagttcaccttcaacatcctaaagcaggttgaagaggaagatggttccaggtcacttacaagaacaggaacagcccctccctccaaatttgagcccagaaaggagaacctttgttactctagaaaacagtgtgtgtgctattgttttctccataggtcacaaacatccacaagatattggtgattttacatattattagagccactgaaatttatgatgcaggatattaacgtcaaagaggccaagatgcatcattcagaacactggcaggtcaagcagaaaccaccgtagtaaaattgaaagctggagtcagcaaagtatagcccacagccaaatctggcccatcccctgttcttataaagttttattggaacgcagccatgctcatcggtttatgtattatctatggctgtttccaactacagtggcagagctgaatagttgcaaaggaccatagggctatcaaagccccaaatagtcattgtctgacccttcatagaaaaattttgctgaactgtagtctagctccaaggattgttgtatcacctgtgatcgtgcctattaagcaattaacgtcatgtctagtacttagtaatgactcagcatgtatcaattacgatgataaatattatcatggcatccaaaccaaaatactcatgccaacatctctctgtacagaaacatggaaaaagagcgatgctattaaggaggaaaatggagccaggagcaaaacctaaggctatttctgaactaaagaggcctgaataaggtagtgaaaggaccagggaaagccttcccacggggatggagagccacctcctccccggctttctggttcagatgtcttgtctcaacagacggcagattcgcagggaagcaggccgagcctgatcttttctccgctagaactgctcaacaggtgaagaatctttttccagcactcctgagcccttcgggtcgcggaacagtgcgaagattattccaatgcctcattcggagaggtgataatctggtctgtggtttctttttcggtggggcatggggtgggggtgagtgtcatgctttctaaggcacagggctgactaaagggtgtcctatttataagtcagtaaaacacagcggcttcatactctgtgcttattacccagaagccccggctcttagagtttctattaagatgtacctcataaatatatacgcctcctatgtacccacaaaaattaaaaataaaaaaattgaaatca

SEQ ID NO: 10461 - DNA, 1499 bp, Homo sapiens
tccacgtttctttagcgggcagtggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatg

SEQ ID NO: 10462 - DNA, 14534 bp, Homo sapiens
ggagttttccaccatgactattgccctgctgggttttgccatattcttgctccattgtgcgacctgtgagaagcctctagaagggattctctcctcctctgcttggcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgcagtatgttctaaagccatcttcagagaatgtaggatttaaacttaatgctcgaactgggttgatcaccaccacaaagctcatggacttccacgacagagcccactatcagctacacatcagaacctcaccgggccaggcctccaccgtggtggtcattgacattgtggactgcaacaaccatgcccccctcttcaacaggtcttcctatgatggtaccttggatgagaacatccctccaggcaccagtgttttggctgtgactgccactgaccgggatcatggggaaaatggatatgtcacctattccattgctggaccaaaagctttgccattttctattgacccctacctggggatcatctccacctccaaacccatggactatgaactcatgaaaagaatttataccttccgggtaagagcatcagactggggatccccttttcgccgggagaaggaagtgtccatttttcttcagctcaggaacttgaatgacaaccagcctatgtttgaagaagtcaactgtacagggtctatccgccaagactggccagtagggaaatcgataatgactatgtcagccatagatgtggatgagcttcagaacctaaaatacgagattgtatcaggcaatgaactagagtattttgatctaaatcatttctccggagtgatatccctcaaacgcccttttatcaatcttactgctggtcaacccaccagttattccctgaagattacagcctcagatggcaaaaactatgcctcacccacaactttgaatattactgtggtgaaggaccctcattttgaagttcctgtaacatgtgataaaacaggggtattgacacaattcacaaagactatcctccactttattgggcttcagaaccaggagtccagtgatgaggaattcacttctttaagcacatatcagattaatcattacaccccacagtttgaggaccacttcccccaatccattgatgtccttgagagtgtccctatcaacacccccttggcccgcctagcagccactgaccctgatgctggttttaatggcaaactggtctatgtgattgcagatggcaatgaggagggctgctttgacatagagctggagacagggctgctcactgtagctgctcccttggactatgaagccaccaatttctacatcctcaatgtaacagtatatgacctgggcacaccccagaagtcctcctggaagctgctgacagtgaatgtgaaagactggaatgacaacgcacccagatttcctcccggtgggtaccagttaaccatctcggaggacacagaagttggaaccacaattgcagagctgacaaccaaagatgctgactcggaagacaatggcagggttcgctacaccctgctaagtcccacagagaagttctccctccaccctctcactggggaactggttgttacaggacacctggaccgcgaatcagagcctcggtacatactcaaggtggaggccagggatcagcccagcaaaggccaccagctcttctctgtcactgacctgataatcacattggaggatgtcaacgacaactctccccagtgcatcacagaacacaacaggctgaaggttccagaggacctgccccccgggactgtcttgacatttctggatgcctctgatcctgacctgggccccgcaggtgaagtgcgatatgttctgatggatggcgcccatgggaccttccgggtggacctgatgacaggggcgctcattctggagagagagctggactttgagaggcgagctgggtacaatctgagcctgtgggccagtgatggtgggaggcccctagcccgcaggactctctgccatgtggaggtgatcgtcctggatgtgaatgagaatctccaccctccccactttgcctccttcgtgcaccagggccaggtgcaggagaacagcccctcgggaactcaggtgattgtagtggctgcccaggacgatgacagtggcttggatggggagctccagtacttcctgcgtgctggcactggactcgcagccttcagcatcaaccaagatacaggaatgattcagactctggcacccctggaccgagaatttgcatcttactactggttgacggtattagcagtggacaggggttctgtgcccctctcttctgtaactgaagtctacatcgaggttacggatgccaatgacaacccaccccagatgtcccaagctgtgttctacccctccatccaggaggatgctcccgtgggcacctctgtgcttcaactggatgcctgggacccagactccagctccaaagggaagctgaccttcaacatcaccagtgggaactacatgggattctttatgattcaccctgttacaggtctcctatctacagcccagcagctggacagagagaacaaggatgaacacatcctggaggtgactgtgctggacaatggggaaccctcactgaagtccacctccagggtggtggtaggcatcttggacgtcaatgacaatccacctatattctcccacaagctcttcaatgtccgccttccagagaggctgagccctgtgtcccctgggcctgtgtacaggctggtggcttcagacctggatgagggtcttaatggcagagtcacctacagtatcgaggacagcgatgaggaggccttcagtatcgacctggtcacaggtgtggtttcatccagcagcacttttacagctggagagtacaacatcctaacgatcaaggcaacagacagtgggcagccaccactctcagccagtgtccggctacacattgagtggatcccttggccccggccgtcctccatccctctggcctttgatgagacctactacagctttacggtcatggagacggaccctgtgaaccacatggtgggggtcatcagcgtagagggcagacccggactcttctggttcaacatctcaggtggggataaggacatggactttgacattgagaagaccacaggcagcatcgtcattgccaggcctcttgataccaggagaaggtcgaactataacttgactgttgaggtgacagatgggtcccgcaccattgccacacaggtccacatcttcatgattgccaacattaaccaccatcggccccagtttctggaaactcgttatgaagtcagagttccccaggacaccgtgccaggggtagagctcctgcgagtccaggccatagatcaagacaagggcaaaagcctcatctataccatacatggcagccaagacccaggaagtgccagcctcttccagctggacccaagcagtggtgtcctggtaacggtgggaaaattggacctcggctcggggccctcccagcacacactgacagtcatggtccgagaccaggaaatacctatcaagaggaacttcgtgtgggtgaccattcatgtggaggatggaaacctccacccaccccgcttcactcagctccattatgaggcaagtgttcctgacaccatagcccccggcacagagctgctgcaggtccgagccatggatgctgaccggggagtcaatgctgaggtccactactccctcctgaaagggaacagcgaaggtttcttcaacatcaatgccctgctaggcatcattactctagctcaaaagcttgatcaggcaaatcatgccccacatactctgacagtgaaggcagaagatcaaggctccccacaatggcatgacctggctacagtgatcattcatgtctatccctcagataggagtgcccccatcttttcaaaatctgagtactttgtagagatccctgaatcaatccctgttggttccccaatcctccttgtctctgctatgagcccctctgaagttacctatgagttaagagagggaaataaggatggagtcttctctatgaactcatattctggccttatttccacccagaagaaattggaccatgagaaaatctcgtcttaccagctgaaaatccgaggcagcaatatggcaggtgcatttactgatgtcatggtggtggttgacataattgatgaaaatgacaatgctcctatgttcttaaagtcaacttttgtgggccaaattagtgaagcagctccactgtatagcatgatcatggataaaaacaacaacccctttgtgattcatgcctctgacagtgacaaagaagctaattccttgttggtctataaaattttggagccggaggccttgaagtttttcaaaattgatcccagcatgggaaccctaaccattgtatcagagatggattatgagagcatgccctctttccaattctgtgtctatgtccatgaccaaggaagccctgtattatttgcacccagacctgcccaagtcatcattcatgtcagagatgtgaatgattcccctcccagattctcagaacagatatatgaggtagcaatagtcgggcctatccatccaggcatggagcttctcatggtgcgggccagcgatgaagactcagaagtcaattatagcatcaaaactggcaatgctgatgaagctgttaccatccatcctgtcactggtagcatatctgtgctgaatcctgctttcctgggactctctcggaagctcaccatcagggcttctgatggcttgtatcaagacactgcgctggtaaaaatttctttgacccaagtgcttgacaaaagcttgcagtttgatcaggatgtctactgggcagctgtgaaggagaacttgcaggacagaaaggcactggtgattcttggtgcccagggcaatcatttgaatgacaccctttcctactttctcttgaatggcacagatatgtttcatatggtccagtcagcaggtgtgttgcagacaagaggtgtggcgtttgaccgggagcagcaggacactcatgagttggcagtggaagtgagggacaatcggacacctcagcgggtggctcagggtttggtcagagtctctattgaggatgtcaatgacaatccccccaaatttaagcatctgccctattacacaatcatccaagatggcacagagccaggggatgtcctctttcaggtatctgccactgatgaggacttggggacaaatggggctgttacatatgaatttgcagaagattacacatatttccgaattgacccctatcttggggacatatcactcaagaaaccctttgattatcaagctttaaataaatatcacctcaaagtcattgctcgggatggaggaacgccatccctccagagtgaggaagaggtacttgtcactgtgagaaataaatccaacccactgtttcagagtccttattacaaagtcagagtacctgaaaatatcaccctctataccccaattctccacacccaggcccggagtccagagggactccggctcatctacaacattgtggaggaagaacccttgatgctgttcaccactgacttcaagactggtgtcctaacagtaacagggcctttggactatgagtccaagaccaaacatgtgttcacagtcagagccacggatacagctctggggtcattttctgaagccacagtggaagtcctagtggaggatgtcaatgataaccctcccactttttcccaattggtctataccacttccatctcagaaggcttgcctgctcagacccctgtgatccaactgttggcttctgaccaggactcagggcggaaccgtgacgtctcttatcagattgtggaggatggctcagatgtttccaagttcttccagatcaatgggagcacaggggagatgtccacagttcaagaactggattatgaagcccaacaacactttcatgtgaaagtcagggccatggataaaggagatcccccactcactggtgaaacccttgtggttgtcaatgtgtctgatatcaatgacaaccccccagagttcagacaacctcaatatgaagccaatgtcagtgaactggcaacctgtggacacctggttcttaaagtccaggctattgaccctgacagcagagacacctcccgcctggagtacctgattctttctggcaatcaggacaggcacttcttcattaacagctcatcgggaataatttctatgttcaacctttgcaaaaagcacctggactcttcttacaatttgagggtaggtgcttctgatggagtcttccgagcaactgtgcctgtgtacatcaacactacaaatgccaacaagtacagcccagagttccagcagcacctttatgaggcagaattagcagagaatgcaatggttggaaccaaggtgattgatttgctagccatagacaaagatagtggtccctatggcactatagattatactatcatcaataaactagcaagtgagaagttctccataaaccccaatggccagattgccactctgcagaaactggatcgggaaaattcaacagagagagtcattgctattaaggtcatggctcgggatggaggaggaagagtagccttctgcacggtgaagatcatcctcacagatgaaaatgacaaccccccacagttcaaagcatctgagtacacagtatccattcaatccaatgtcagtaaagactctccggttatccaggtgttggcctatgatgcagatgaaggtcagaacgcagatgtcacctactcagtgaacccagaggacctagttaaagatgtcattgaaattaacccagtcactggtgtggtcaaggtgaaagacagcctggtgggattggaaaatcagacccttgacttcttcatcaaagcccaagatggaggccctcctcactggaactctctggtgccagtacgacttcaggtggttcctaaaaaagtatccttaccgaaattttctgaacctttgtatactttctctgcacctgaagaccttccagaggggtctgaaattgggattgttaaagcagtggcagctcaagatccagtcatctacagtctagtgcggggcactacacctgagagcaacaaggatggtgtcttctccctagacccagacacaggggtcataaaggtgaggaagcccatggaccacgaatccaccaaattgtaccagattgatgtgatggcacattgccttcagaacactgatgtggtgtccttggtctctgtcaacatccaagtgggagacgtcaatgacaataggcctgtatttgaggctgatccatataaggctgtcctcactgagaatatgccagtggggacctcagtcattcaagtgactgccattgacaaggacactgggagagatggccaggtgagctacaggctgtctgcagaccctggtagcaatgtccatgagctctttgccattgacagtgagagtggttggatcaccacactccaggaacttgactgtgagacctgccagacttatcattttcatgtggtggcctatgaccacggacagaccatccagctatcctctcaggccctggttcaggtctccattacagatgagaatgacaatgctccccgatttgcttctgaagagtacagaggatctgtggttgagaacagtgagcctggcgaactggtggcgactctaaagaccctggatgctgacatttctgagcagaacaggcaggtcacctgctacatcacagagggagaccccctgggccagtttggcatcagccaagttggagatgagtggaggatttcctcaaggaagaccctggaccgcgagcatacagccaagtacttgctcagagtcacagcatctgatggcaagttccaggcttcggtcactgtggagatctttgtcctggacgtcaatgataacagcccacagtgttcacagcttctctatactggcaaggttcatgaagatgtatttccaggacacttcattttgaaggtttctgccacagacttggacactgataccaatgctcagatcacatattctctgcatggccctggggcgcatgaattcaagctggatcctcatacaggggagctgaccacactcactgccctagaccgagaaaggaaggatgtgttcaaccttgttgccaaggcgacggatggaggtggccgatcgtgccaggcagacatcaccctccatgtggaggatgtgaatgacaatgccccgcggttcttccccagccactgtgctgtggctgtcttcgacaacaccacagtgaagacccctgtggctgtagtatttgcccgggatcccgaccaaggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagggtcttagagaatgcccttgtgggtgacgtcatcctcacggtatcagcgactgatgaagatggacccctaaatagtgacattacctatagcctcataggagggaaccagcttgggcacttcaccattcaccccaaaaagggggagctacaggtggccaaggccctggaccgggaacaggcctctagttattccctgaagctccgagccacagacagtgggcagcctccactgcatgaggacacagacatcgctatccaagtggctgatgtcaatgataacccaccgagattcttccagctcaactacagcaccactgtccaggagaactcccccattggcagcaaagtcctgcagctgatcctgagtgacccagattctccagagaatggccccccctactcgtttcgaatcaccaaggggaacaacggctctgccttccgagtgaccccggatggatggctggtgactgctgagggcctaagcaggagggctcaggaatggtatcagcttcagatccaggcgtcagacagtggcatccctcccctctcgtctttgacgtctgtccgtgtccatgtcacagagcagagccactatgcaccttctgctctcccactggagatcttcatcactgttggagaggatgagttccagggtggcatggtgggtaagatccatgccacagaccgagacccccaggacacgctgacctatagcctggcagaagaggagaccctgggcaggcacttctcagtgggtgcgcctgatggcaagattatcgccgcccagggcctgcctcgtggccactactcgttcaacgtcacggtcagcgatgggaccttcaccacgactgctggggtccatgtgtacgtgtggcatgtggggcaggaggctctgcagcaggccatgtggatgggcttctaccagctcacccccgaggagctggtgagtgaccactggcggaacctgcagaggttcctcagccataagctggacatcaaacgggctaacattcacttggccagcctccagcctgcagaggccgtggctggtgtggatgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccatggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgt

SEQ ID NO: 10463 - DNA, 19126 bp, Homo sapiens
gatggaagtatgatgtgatggatataattatgggacactgtgtgggcacacggcctcctgcttgttgcctcatcctcctgcttttcaagcttttggccactgtctcccaggggctgccagggactggacccctgggcttccacttcacacattccatttataatgctaccgtgtatgagaactcagcagcaaggacctacgtcaacagccagagtagaatgggcatcaccttaatagatctatcctgggatatcaaatacagaatagtgtccggagacgaggaaggctttttcaaagcagaggaagtcatcattgcagatttctgttttctcagaataagaactaaaggtggcaattctgccatattaaatagggaaatccaggataattatttattgatagtaaaaggttctgtcagaggagaggatttggaagcatggaccaaagtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacaggtctgattacaacaacttcaaggaaattggatcgagaacagcaggcagaacattttctggaggtgactgtgacagatggtggtccctctccaaaacagtcaaccatttgggtggtggttcaggttctagatgaaaatgacaacaagccccagttcccagagaaggtctaccagatcaagctgccagaacgtgaccgaaagaagagaggagaaccgatttacagggcttttgcatttgatagagatgagggccccaacgcagaaatctcctacagtattgtggatgggaatgatgacggaaagttctttattgaccctaaaactgggatggtttcttctagaaagcagtttacagcaggcagttatgacatcctaacgataaaggcagtggacaatgggcgcccacagaaatcctccacggcccgcctccacattgaatggattaagaaaccacccccttcacctataccattgaccttcgatgagccgttttataacttcacagtcatggaaagtgatagagtgactgaaattgtaggggtggtgtctgtgcagccagctaacacccctctgtggtttgacatagttggggggaattttgacagcgcttttgatgcagagaagggtgttgggacaattgtcatcgcaaaacctttggatgcagagcagaggtccatctataatatgagtgtggaagtcaccgatgggacaaatgttgctgttactcaggtatttatcaaagtgctggataataatgataatggcccagaattctctcagccgaattacgatgtgacaatttccgaggatgtgcttccagacacggagatcctgcagattgaagccacagatagagatgagaagcacaagctgagctacactgttcatagcagcatcgactccatcagcatgagaaaattccggattgaccctagcactggcgtgctctatactgccgagaggctggaccatgaggcccaggacaagcacattctcaacataatggtcagagatcaggagtttccttatcgaagaaacttggcccgagtcattgtgaatgtggaggatgctaatgatcacagtccttattttaccaacccactgtatgaagcgtctgtgtttgaatctgctgctctgggatcagctgttctgcaagtgacggctctggacaaagacaaaggagaaaatgcagaactcatatataccatagaagcagggaacactgggaacatgtttaagatcgaaccggtcctaggcatcatcaccatttgcaaagaaccagacatgacgacgatgggtcagtttgtcctatccatcaaagtcacagatcagggatccccgccaatgtctgctactgcaattgtgcgcatttccgtcaccatgtctgacaattctcaccccaagttcattcacaaagactaccaagcagaagtaaatgaaaatgttgacattggaacatcagtcattctaatctctgccatcagtcaatctaccctcatttatgaagtcaaagatggagacattaatgggatctttaccataaatccatattctggagtcatcaccactcagaaggccctggattatgagcgcacatcctcttatcaactcatcattcaggccaccaatatggcaggaatggcttccaatgctacagtcaatattcagattgttgatgaaaatgataatgccccagtttttctcttttctcaatactcaggcagcctaagtgaggctgccccaattaatagcattgtcaggagcttggataacagcccactggtgattcgagccacagatgctgacagcaaccggaatgctctgcttgtgtatcagattgtggagtcaacagcaaaaaagtttttcacggtggactccagtacaggtgcaatcagaacaattgccaacctggaccatgaaaccattgcccatttccattttcatgtgcatgtgagagacagtggtagcccccaactgactgcagagagtcccgttgaagtcaacattgaggtgacagatgtgaatgataacccacctgtttttactcaggctgtgtttgagactatcttacttctacctacctatgttggagtggaggttctgaaagttagtgccacagatcctgactctgaggtaccccctgaactgacatacagcctaatggaaggcagtttggatcattttttaattgactcaaacagtggagtacttaccataaaaaacaacaacctctccaaggatcactacatgctgatagttaaggtgtctgatggaaagttctacagtacctccatggtcaccatcatggttaaagaagccatggacagcggcctccactttacacaaagcttctattccacctcaatctcagagaacaacactaacataaccaaagttgctattgtcaatgcagttggaaatcgccttaatgagcccttaaaatacagcatcttaaacccaggaaataagttcaagataaaatctacctcaggggtcattcagacgactggagtcccctttgaccgtgaagaacaagagttatatgagctggtggtagaagccagccgtgagctggaccatctgcgtgtggccagagtggtggtcagggttaacattgaagacataaatgacaattctccagtctttgtgggcctcccatactatgctgctgttcaagtggatgcggaacccgggactctgatttatcaggtgacagccattgacaaagataaaggtccaaatggagaagtgacctatgtcctgcaggatgactatggccactttgaaattaaccctaattcagggaatgttattttaaaggaagcattcaactctgacttgtccaacattgagtatggagtcaccatcctagccaaggatggcggaaaaccttctttgtctacatctgtggagcttcccatcactattgtcaacaaagcaatgcctgtgtttgataagcccttttatacagcatctgtcaatgaagacatcagaatgaacacacccatcctaagcatcaatgccaccagtccagaaggccaaggcatcatatatatcattatcgatggggacccttttaaacagtttaacattgactttgacactggggtcctgaaagttgttagccctttggattatgaagttacatctgcttacaagctgacaataagagccagcgacgcccttactggtgctagggctgaagtcactgttgacttgctagttaatgatgtaaatgacaacccccctattttcgatcagcctacatacaatacaacactatcagaagcatctcttattgggacacctgttttacaagttgtctctattgatgcagactcagaaaacaataaaatggtacattatcagattgtccaggatacctacaatagcacagattattttcacatagatagctcaagtggcttaatcctgacagcacgaatgctggaccatgagttagtacaacactgcactttgaaagtcagatcaatagatagtggcttcccatcactgagcagtgaggttctcgttcatatctacatctctgatgtaaatgacaaccctccagtttttaatcagctcatttatgagtcatatgtgagtgaattagccccccggggccattttgtaacctgtgtacaagcctctgatgcagacagctctgattttgaccggttggaatatagcattttatctgggaatgaccggacgagctttctgatggacagcaagagtggagttatcacattgtccaaccatcggaagcagcggatggagcctctgtacagtctcaatgtgtctgtctctgatgggttgttcaccagcactgcacaggtgcatattagggtacttggggctaacttgtacagccctgccttttcacaaagcacatacgtagctgaggtgagagagaacgtggctgcaggaacaaaggtaattcatgttcgagccacagatggtgatccagggacttatgggcagatcagctatgccatcatcaatgactttgccaaggatcgattcctcatagacagcaatgggcaggtcatcaccacagaaaggctagaccgggaaaaccctctagaaggggatgttagtatttttgtgagggcccttgatggtggagggagaacaactttctgcactgtgagagtgattgttgtggatgaaaatgacaatgctccccagttcatgacagtggaatatagagccagtgtcagggcagatgttggaaggggccacttggtcactcaagttcaagccatagatcccgatgatggagcaaattcaaggattacttattccctctatagcgaggcctctgtttcagtggccgacctcctggaaatcgatcctgacaatggctggatggtcacaaagggtaattttaaccagctgaaaaatacagtgctttcgttctttgtcaaagcagtagatgggggcatcccagtaaagcactccctcattcctgtctatatccacgtcttgccccctgaaacgttcttgccatcattcacccagtctcagtattcctttaccattgcagaagatacagccattgggagtacagtggacaccctgaggattttgcccagtcagaatgtctggttcagcacagttaatggggaacggccagaaaataacaaagggggcatattcgtcatagaacaggaaacaggcactattaagcttgacaaacgccttgaccgtgaaaccagcccagctttccactttaaagtagcagccactatacccctggacaaagtagacattgtgtttactgtggatgtagatatcaaggtattggatttgaatgacaacaagccagtctttgaaacttcaagctatgacaccattataatggaagggatgcctgttggcaccaaactcacacaagtgagagctattgatatggactggggagccaatggacaagtcacttactccctccactcggattcccagcccgaaaaggtaatggaagcattcaatattgacagcaacacgggctggatcagtaccttgaaggacctagatcacgagacagaccccacattcaccttctctgtggtggcctctgaccttggagaggcattctctctttcctccacggccttggtctctgtcagagtgacagatataaatgacaatgcaccagtcttcgcgcaggaagtgtaccgagggaatgtgaaggagagcgacccaccgggcgaggtggtagccgtcctcagcacctgggacagagacacatccgacgttaatcgccaagtgagctaccatattacaggaggaaaccctcgaggaaggtttgctctgggcctggtgcaaagtgagtggaaggtctatgtgaagaggcctctagacagagaagaacaggacatttactttctcaatatcactgccactgatgggctttttgtcacacaggccatggtggaagtgagcgtcagtgatgtgaatgacaatagcccagtgtgtgatcaggttgcatatacagcattacttcctgaagacattccatcaaataaaatcatcctgaaagtcagtgcaaaggatgctgatattggatccaatggatatatacgatactcactctatggatctggaaacagtgaattttttctagatccagaaagtggcgagttaaaaaccttggctctgttggaccgggagaggatccccgtgtacagcctgatggccaaggccactgacgggggtggcaggttctgccagtccaacatccacctaatcctggaggatgtgaatgataacccccctgtgttttcttctgaccactacaacacctgtgtctatgagaacacagccaccaaggctctgttgaccagagttcaagccgtggaccccgacattggcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaaccccaagacagggggtatttctgtctctgaagtcctggactatgaattatgcaaaaggttttacctggtagtggaagccaaagatgggggcaccccagctctcagcgctgtggccactgtcaacatcaacctcacagatgttaatgacaaccctcccaagttcagccaagacgtctacagtgcggttatcagtgaagacgccttggtgggagactctgtcattttgctaatagcagaagatgtagacagccagcccaacggacagattcatttttccattgtgaatggagatcgggacaatgaatttactgtagatcctgtcttgggacttgtgaaagttaagaagaaattggaccgggaacgggtgtctggatactctctgcttgtccaggccgtagacagtggcattcctgcaatgtcatcaactgcaactgtcaacattgatatttctgatgtgaatgacaacagcccggtgtttacacctgccaactatactgctgtgattcaggaaaataagccagtgggcaccagcatcttgcagctggtggtgacagacagagactcctttcacaatgggcctcccttttcattctctattttgtcgggaaatgaagaggaggagtttgtgttggaccctcatgggatcttgcggtcggctgtggtcttccagcacacagagtctctggaatacgtgttgtgtgtccaggcaaaggattcaggcaaaccccagcaagtttctcacacttacatccgcgtgcgagtcattgaggaaagcacccacaagcccacagccattcccctggaaattttcattgtcaccatggaggatgactttcctggtggggtcattgggaagattcatgccacagatcaagacatgtatgatgtgctcacatttgccctgaaatcggagcagaaaagcttatttaaagtgaacagtcacgatgggaaaatcatcgccctgggaggcctggacagcggcaagtatgtcctgaatgtgtctgtgagtgatggtcgcttccaggtacccattgatgtggtcgtgcatgtggagcagttggtgcatgagatgctgcagaacactgtcaccatccgctttgaaaatgtgtcccctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctccatagtgactgtcattcagcttgtcaacaatgtagttgacactatagagaatgaagtgtctgtcatggaccaaggacagaactacaaccgagcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaaagaaaagaaaaaaaaaacaaaagcaaacaaaaaaaaagacagccaaaaaaaagaaacaacaacaacaaaaaaaaacacaacagtgtacaggtttgtaactgccaaaatttgatggttaaaacaagttttcaagt

SEQ ID NO: 10464 - DNA, 19030 bp, Homo sapiens
gatggaagtatgatgtgatggatataattatgggacactgtgtgggcacacggcctcctgcttgttgcctcatcctcctgcttttcaagcttttggccactgtctcccaggggctgccagggactggacccctgggcttccacttcacacattccatttataatgctaccgtgtatgagaactcagcagcaaggacctacgtcaacagccagagtagaatgggcatcaccttaatagatctatcctgggatatcaaatacagaatagtgtccggagacgaggaaggctttttcaaagcagaggaagtcatcattgcagatttctgttttctcagaataagaactaaaggtggcaattctgccatattaaatagggaaatccaggataattatttattgatagtaaaaggttctgtcagaggagaggatttggaagcatggaccaaagtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacaggtctgattacaacaacttcaaggaaattggatcgagaacagcaggcagaacattttctggaggtgactgtgacagatggtggtccctctccaaaacagtcaaccatttgggtggtggttcaggttctagatgaaaatgacaacaagccccagttcccagagaaggtctaccagatcaagctgccagaacgtgaccgaaagaagagaggagaaccgatttacagggcttttgcatttgatagagatgagggccccaacgcagaaatctcctacagtattgtggatgggaatgatgacggaaagttctttattgaccctaaaactgggatggtttcttctagaaagcagtttacagcaggcagttatgacatcctaacgataaaggcagtggacaatgggcgcccacagaaatcctccacggcccgcctccacattgaatggattaagaaaccacccccttcacctataccattgaccttcgatgagccgttttataacttcacagtcatggaaagtgatagagtgactgaaattgtaggggtggtgtctgtgcagccagctaacacccctctgtggtttgacatagttggggggaattttgacagcgcttttgatgcagagaagggtgttgggacaattgtcatcgcaaaacctttggatgcagagcagaggtccatctataatatgagtgtggaagtcaccgatgggacaaatgttgctgttactcaggtatttatcaaagtgctggataataatgataatggcccagaattctctcagccgaattacgatgtgacaatttccgaggatgtgcttccagacacggagatcctgcagattgaagccacagatagagatgagaagcacaagctgagctacactgttcatagcagcatcgactccatcagcatgagaaaattccggattgaccctagcactggcgtgctctatactgccgagaggctggaccatgaggcccaggacaagcacattctcaacataatggtcagagatcaggagtttccttatcgaagaaacttggcccgagtcattgtgaatgtggaggatgctaatgatcacagtccttattttaccaacccactgtatgaagcgtctgtgtttgaatctgctgctctgggatcagctgttctgcaagtgacggctctggacaaagacaaaggagaaaatgcagaactcatatataccatagaagcagggaacactgggaacatgtttaagatcgaaccggtcctaggcatcatcaccatttgcaaagaaccagacatgacgacgatgggtcagtttgtcctatccatcaaagtcacagatcagggatccccgccaatgtctgctactgcaattgtgcgcatttccgtcaccatgtctgacaattctcaccccaagttcattcacaaagactaccaagcagaagtaaatgaaaatgttgacattggaacatcagtcattctaatctctgccatcagtcaatctaccctcatttatgaagtcaaagatggagacattaatgggatctttaccataaatccatattctggagtcatcaccactcagaaggccctggattatgagcgcacatcctcttatcaactcatcattcaggccaccaatatggcaggaatggcttccaatgctacagtcaatattcagattgttgatgaaaatgataatgccccagtttttctcttttctcaatactcaggcagcctaagtgaggctgccccaattaatagcattgtcaggagcttggataacagcccactggtgattcgagccacagatgctgacagcaaccggaatgctctgcttgtgtatcagattgtggagtcaacagcaaaaaagtttttcacggtggactccagtacaggtgcaatcagaacaattgccaacctggaccatgaaaccattgcccatttccattttcatgtgcatgtgagagacagtggtagcccccaactgactgcagagagtcccgttgaagtcaacattgaggtgacagatgtgaatgataacccacctgtttttactcaggctgtgtttgagactatcttacttctacctacctatgttggagtggaggttctgaaagttagtgccacagatcctgactctgaggtaccccctgaactgacatacagcctaatggaaggcagtttggatcattttttaattgactcaaacagtggagtacttaccataaaaaacaacaacctctccaaggatcactacatgctgatagttaaggtgtctgatggaaagttctacagtacctccatggtcaccatcatggttaaagaagccatggacagcggcctccactttacacaaagcttctattccacctcaatctcagagaacaacactaacataaccaaagttgctattgtcaatgcagttggaaatcgccttaatgagcccttaaaatacagcatcttaaacccaggaaataagttcaagataaaatctacctcaggggtcattcagacgactggagtcccctttgaccgtgaagaacaagagttatatgagctggtggtagaagccagccgtgagctggaccatctgcgtgtggccagagtggtggtcagggttaacattgaagacataaatgacaattctccagtctttgtgggcctcccatactatgctgctgttcaagtggatgcggaacccgggactctgatttatcaggtgacagccattgacaaagataaaggtccaaatggagaagtgacctatgtcctgcaggatgactatggccactttgaaattaaccctaattcagggaatgttattttaaaggaagcattcaactctgacttgtccaacattgagtatggagtcaccatcctagccaaggatggcggaaaaccttctttgtctacatctgtggagcttcccatcactattgtcaacaaagcaatgcctgtgtttgataagcccttttatacagcatctgtcaatgaagacatcagaatgaacacacccatcctaagcatcaatgccaccagtccagaaggccaaggcatcatatatatcattatcgatggggacccttttaaacagtttaacattgactttgacactggggtcctgaaagttgttagccctttggattatgaagttacatctgcttacaagctgacaataagagccagcgacgcccttactggtgctagggctgaagtcactgttgacttgctagttaatgatgtaaatgacaacccccctattttcgatcagcctacatacaatacaacactatcagaagcatctcttattgggacacctgttttacaagttgtctctattgatgcagactcagaaaacaataaaatggtacattatcagattgtccaggatacctacaatagcacagattattttcacatagatagctcaagtggcttaatcctgacagcacgaatgctggaccatgagttagtacaacactgcactttgaaagtcagatcaatagatagtggcttcccatcactgagcagtgaggttctcgttcatatctacatctctgatgtaaatgacaaccctccagtttttaatcagctcatttatgagtcatatgtgagtgaattagccccccggggccattttgtaacctgtgtacaagcctctgatgcagacagctctgattttgaccggttggaatatagcattttatctgggaatgaccggacgagctttctgatggacagcaagagtggagttatcacattgtccaaccatcggaagcagcggatggagcctctgtacagtctcaatgtgtctgtctctgatgggttgttcaccagcactgcacaggtgcatattagggtacttggggctaacttgtacagccctgccttttcacaaagcacatacgtagctgaggtgagagagaacgtggctgcaggaacaaaggtaattcatgttcgagccacagatggtgatccagggacttatgggcagatcagctatgccatcatcaatgactttgccaaggatcgattcctcatagacagcaatgggcaggtcatcaccacagaaaggctagaccgggaaaaccctctagaaggggatgttagtatttttgtgagggcccttgatggtggagggagaacaactttctgcactgtgagagtgattgttgtggatgaaaatgacaatgctccccagttcatgacagtggaatatagagccagtgtcagggcagatgttggaaggggccacttggtcactcaagttcaagccatagatcccgatgatggagcaaattcaaggattacttattccctctatagcgaggcctctgtttcagtggccgacctcctggaaatcgatcctgacaatggctggatggtcacaaagggtaattttaaccagctgaaaaatacagtgctttcgttctttgtcaaagcagtagatgggggcatcccagtaaagcactccctcattcctgtctatatccacgtcttgccccctgaaacgttcttgccatcattcacccagtctcagtattcctttaccattgcagaagatacagccattgggagtacagtggacaccctgaggattttgcccagtcagaatgtctggttcagcacagttaatggggaacggccagaaaataacaaagggggcatattcgtcatagaacaggaaacaggcactattaagcttgacaaacgccttgaccgtgaaaccagcccagctttccactttaaagtagcagccactatacccctggacaaagtagacattgtgtttactgtggatgtagatatcaaggtattggatttgaatgacaacaagccagtctttgaaacttcaagctatgacaccattataatggaagggatgcctgttggcaccaaactcacacaagtgagagctattgatatggactggggagccaatggacaagtcacttactccctccactcggattcccagcccgaaaaggtaatggaagcattcaatattgacagcaacacgggctggatcagtaccttgaaggacctagatcacgagacagaccccacattcaccttctctgtggtggcctctgaccttggagaggcattctctctttcctccacggccttggtctctgtcagagtgacagatataaatgacaatgcaccagtcttcgcgcaggaagtgtaccgagggaatgtgaaggagagcgacccaccgggcgaggtggtagccgtcctcagcacctgggacagagacacatccgacgttaatcgccaagtgagctaccatattacaggaggaaaccctcgaggaaggtttgctctgggcctggtgcaaagtgagtggaaggtctatgtgaagaggcctctagacagagaagaacaggacatttactttctcaatatcactgccactgatgggctttttgtcacacaggccatggtggaagtgagcgtcagtgatgtgaatgacaatagcccagtgtgtgatcaggttgcatatacagcattacttcctgaagacattccatcaaataaaatcatcctgaaagtcagtgcaaaggatgctgatattggatccaatggatatatacgatactcactctatggatctggaaacagtgaattttttctagatccagaaagtggcgagttaaaaaccttggctctgttggaccgggagaggatccccgtgtacagcctgatggccaaggccactgacgggggtggcaggttctgccagtccaacatccacctaatcctggaggatgtgaatgataacccccctgtgttttcttctgaccactacaacacctgtgtctatgagaacacagccaccaaggctctgttgaccagagttcaagccgtggaccccgacattggcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaaccccaagacagggggtatttctgtctctgaagtcctggactatgaattatgcaaaaggttttacctggtagtggaagccaaagatgggggcaccccagctctcagcgctgtggccactgtcaacatcaacctcacagatgttaatgacaaccctcccaagttcagccaagacgtctacagtgcggttatcagtgaagacgccttggtgggagactctgtcattttgctaatagcagaagatgtagacagccagcccaacggacagattcatttttccattgtgaatggagatcgggacaatgaatttactgtagatcctgtcttgggacttgtgaaagttaagaagaaattggaccgggaacgggtgtctggatactctctgcttgtccaggccgtagacagtggcattcctgcaatgtcatcaactgcaactgtcaacattgatatttctgatgtgaatgacaacagcccggtgtttacacctgccaactatactgctgtgattcaggaaaataagccagtgggcaccagcatcttgcagctggtggtgacagacagagactcctttcacaatgggcctcccttttcattctctattttgtcgggaaatgaagaggaggagtttgtgttggaccctcatgggatcttgcggtcggctgtggtcttccagcacacagagtctctggaatacgtgttgtgtgtccaggcaaaggattcaggcaaaccccagcaagtttctcacacttacatccgcgtgcgagtcattgaggaaagcacccacaagcccacagccattcccctggaaattttcattgtcaccatggaggatgactttcctggtggggtcattgggaagattcatgccacagatcaagacatgtatgatgtgctcacatttgccctgaaatcggagcagaaaagcttatttaaagtgaacagtcacgatgggaaaatcatcgccctgggaggcctggacagcggcaagtatgtcctgaatgtgtctgtgagtgatggtcgcttccaggtacccattgatgtggtcgtgcatgtggagcagttggtgcatgagatgctgcagaacactgtcaccatccgctttgaaaatgtgtcccctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaaagaaaagaaaaaaaaaacaaaagcaaacaaaaaaaaagacagccaaaaaaaagaaacaacaacaacaaaaaaaaacacaacagtgtacaggtttgtaactgccaaaatttgatggttaaaacaagttttcaagt

SEQ ID NO: 10465 - DNA, 3782 bp, Homo sapiens
gatggaagtatgatgtgatggatataattatgggacactgtgtgggcacacggcctcctgcttgttgcctcatcctcctgcttttcaagcttttggccactgtctcccaggggctgccagggactggacccctgggcttccacttcacacattccatttataatgctaccgtgtatgagaactcagcagcaaggacctacgtcaacagccagagtagaatgggcatcaccttaatagatctatcctgggatatcaaatacagaatagtgtccggagacgaggaaggctttttcaaagcagaggaagtcatcattgcagatttctgttttctcagaataagaactaaaggtggcaattctgccatattaaatagggaaatccaggataattatttattgatagtaaaaggttctgtcagaggagaggatttggaagcatggaccaaagtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacagggtcttgctctgttgcccaggctggaatgcagtggcatgatcatagctcactgcaatctcgaactcctggattcaagggatacccctgcctcagcctcttgagtagctgggactataggcatgcaccgccatgcccagctacttttttaaatagttga

SEQ ID NO: 10466 - DNA, 9669 bp, Homo sapiens
atggtaacaacggtagtggcagtgggtgataccttagctcaaccattagctgcagctgaagtgtttattgtagaaataacacttcaggatatcaatgacaatccaccagtatttccaacggacatgctggatctcacggtagaggagaacattggagatggctctaagattatgcagctgacagccatggatgctgatgagggtgcaaatgctctcgtcacatacactatcattagtggagctgatgatagttttcgcatcgacccagaatccggagatctgatagcaaccaggcggttggacagggaacgccgctccaaatattcactgctagttcgtgctgatgatggtcttcagtcctcggatatgagaattaatatcactgtcagtgatgtgaatgaccatacacccaaattttccagacccgtgtactcttttgacattcctgaggacacaatccctggttctttggtagcagccattttagccacggatgatgactctggtgtgaatggagaaattacatatattgtgaatgaagatgatgaagatggcatctttttcctgaatcctattactggggtctttaatttgactcgattattagattatgaagtacagcaatattatatcctcactgttcgagcagaagatggtgggggacaatttactaccatcagagtttatttcaatattctagatgtaaatgataatccacctattttcagcttgaattcatacagcacatctttaatggagaatctacctgtgggatctactgttcttgtgtttaatgttactgatgcagatgatggcatcaactctcaattgacttatagcattgcttcaggtgatagccttgggcagtttactgttgacaagaatggtgtactcaaagtcctaaaagctttggatcgggaaagtcagtccttctacaacttggttgttcaagtgcatgacctgccacagattccagcctccagattcacaagcactgctcaagtctccattattttgttggatgtaaatgataacccaccgacatttctttcccctaaattgacatacattccagaaaatacacctattgatactgttgttttcaaagctcaagcaactgacccagatagtggcccaaacagctatattgagtacactctgctgaaccctttgggaaacaagttcagtattgggaccattgatggtgaagtgaggctcactggagaactggacagagaagaagtttctaattatactctaacagtggtggctacagacaaaggtcaaccatctctctcttcatctacagaggttgtagttatggtacttgacatcaatgataacaaccccatctttgcacaagctttgtataaagtggagattaatgaaaacacacttactggaacagatataatacaagtgttcgcagcagatggagatgaaggcacaaatggacaggttcgctatggcattgttaatggtaataccaatcaggaatttcggatagactctgtcacaggtgccatcactgtcgctaaacctttggatagagaaaagacccctacctaccatttaactgttcaggcaacagatcgaggcagcacacccagaactgatacctccacggtcagcattgttctactggatattaatgactttgttcctgtatttgagctatctccatattctgtaaatgtccctgagaatttagggacactacccagaacaattcttcaggtggtggcaagagatgatgatcgaggatctaacagcaaactctcatatgttctgtttggtggtaatgaagacaatgcttttactctctcagccagtggagaacttggagtaacacagagtctggatcgggaaacaaaagagcgctttgtcttaatgattacagctacagattcaggatcccctgccttgactggaactggaacaatcaacgtcatagtagatgatgtcaatgacaatgtccccacatttgccagtaaagcgtatttcacaacaattcctgaggatgcaccaactggaacagatgttttattggtaaatgcctcagatgctgatgcttcaaagaatgcagttataaggatcatcggtggaaactctcagttcacgatcaacccatcgacaggacaaatcatcaccagcgcattgttagatagggaaacaaaagataattatactttggtagtggtctgcagtgatgcgggatccccagagcctctttccagttccaccagtgtgcttgtcactgtgactgatgtcaatgacaatccaccaagatttcagcatcacccatatgtcactcacatcccatctcctactcttccaggttcctttgtctttgcggttacagtcacagatgctgatattggaccaaattctgaactgcattattctctttcgggtagaaattctgaaaaatttcacattgacccactgaggggagccattatggccgccggaccactaaacggagcttcagaagtgacattttctgtgcatgtaaaagatggtggctcatttccaaagacagattctacaacagtgactgttagattcgtgaataaggccgatttccctaaagtgagagccaaagaacaaacgttcatgtttcctgaaaaccaaccagtcagctctcttgtcaccaccatcacaggatcctctttaagaggagaacctatgtcatattatatcgcaagtgggaatcttggcaatactttccagattgatcagttaacagggcaggtgtctattagtcaacctctggattttgaaaagatacaaaaatatgttgtatggatagaggccagagacggtggtttccctcctttctcctcttacgagaaacttgatataacagtattagatgtcaatgataatgccccaatttttaaggaagacccatttatatctgaaatattggaaaacctttcccctcgaaaaatacttactgtttcggcaatggacaaggacagtggacccaatggacagttagattatgaaattgttaatggcaacatggaaaatagtttcagtatcaatcatgctactggtgaaattagaagcgttagacctttggacagggaaaaagtatctcattatgtcctaaccataaaatcatcagacaaagggtccccgtctcagagtacttcagtaaaagtcatgattaacattttagatgaaaatgataatgcccctaggttttctcagatatttagtgcccatgttcctgaaaattcccccttaggatacacagttacccgtgtcacaacttctgatgaagacattgggatcaatgcaattagtagatattctataatggatgcaagtcttccatttacaattaatcccagcacaggggatattgtcataagcagacctttaaatagggaagatacagaccgttacagaattcgagtttccgcacatgattctgggtggactgtaagtacagatgtcacaatatttgtgacagacatcaatgacaatgctccaagatttagcagaacttcctattatttagattgccctgaacttactgagattggctccaaagtaactcaggtatttgcaacagatcctgatgagggatcaaatggacaagtgttttatttcataaaatcccaatcagaatatttcaggattaatgccaccactggagagattttcaataaacagatcttaaaataccaaaatgtcactggcttcagtaatgtgaatatcaacaggcatagttttatagtgacatcttcagatcgaggtaaaccttccttaattagtgagacaacagttaccatcaatatagtggacagtaatgacaatgcacctcaatttcttaaaagtaaatatttcactccagtcaccaaaaatgttaaggttggtacgaagttaatcagagttacagcaatagatgacaaagattttggactgaattcagaagtggagtatttcatttctaatgataaccatttaggaaaatttaagttggacaatgatacggggtggatttcagtagcatcctccctgatttctgacttgaaccaaaacttttttatcacagtcactgcaaaggataagggaaaccctccactttcttcccaagcaactgttcacataactgtcactgaggaaaactaccatacacctgaattctctcaaagccacatgagtgcaaccatccctgagagccatagcattgggtccattgtcagaactgtttctgcaagagatagagatgcagcgatgaatggcttgattaagtacagcatttcttcaggaaatgaagaaggcatttttgcaatcaattcttctacaggtatattaacactagccaaagctcttgattatgagctatgccagaaacacgaaatgacgattagtgctatagatggaggatgggttgcaagaactggttactgcagtgtgaccgtaaatgtgattgatgtgaatgataattctccagtattcctctctgatgactatttccctactgttttggaaaatgccccaagtggaacaacagttatccacctaaatgcaacagatgctgactctggaacaaatgctgtgattgcgtatactgtacagtcatctgacagtgacctctttgtcattgaccctaacacaggagtcataaccactcaaggcttcttggattttgaaaccaagcagagctaccatcttactgtgaaagccttcaatgtccccgatgaggaaaggtgtagctttgccactgttaatatacaattaaaagggacaaatgaatatgtgccccgttttgtttccaaactttactattttgaaatctcagaagcagctcctaaaggtactattgttggagaagtgtttgctagcgaccgtgatttgggcactgatggggaggtacactatttgatttttggtaatagtcgaaagaagggtttccagatcaataagaagactggacagatttatgtttctggaattcttgatcgagaaaaagaagaaagggtgtctttgaaggtattggccaagaactttggcagcattagaggtgcagatatagatgaggtcactgtaaatgtcaccgtgcttgatgcaaatgacccacccatttttactctaaacatctacagtgtgcagatcagtgaaggggtcccaataggaactcatgtgacctttgtcagtgcctttgactcagactccatccccagctggagcaggttttcttacttcatcggatcagggaatgaaaatggtgccttttctattaatccgcagacaggacagatcaccgttactgcagaattagatcgagaaacccttcccatctataatctctcagttttggctgttgattcagggaccccctcagctacaggtagtgcctctttattagtcaccctggaagatataaatgataacgggcccatgctgactgtcagtgaaggagaagtcatggaaaacaaacggccaggcactttggtgatgacccttcagtccactgaccctgatctccctccaaatcaaggtccctttacttattacttgctgagcacaggtcctgccaccagttatttcagtctgagcactgctggagttctgagcacaaccagagagattgacagagagcagattgcagacttctatctgtctgtggttaccaaggattctggtgttcctcaaatgtcttccacaggaactgtgcatatcacagttatagaccaaaatgacaatccttcacagtctcggacggtggagatatttgttaattattatggtaacttgtttcccggtgggattttaggctctgtgaagccacaggatccagatgtgttagacagcttccactgctcccttacttcaggagttaccagcctcttcagtattccagggggtacttgtgatctgaattcccagccaaggtccacagatggcacgtttgatctgactgtccttagcaatgatggagttcacagcacagtcacgagcaacatccgagttttctttgctggattttccaatgccacagtggataacagcatcttacttcgtctcggcgtaccaacagtaaaggacttcttgaccaaccactatcttcattttttacgcattgccagctcacagctgacaggcttagggactgctgtgcaactgtacagtgcatatgaagagaacaatagaacgtttcttttggcagctgtgaagcgaaatcataatcagtatgtgaatcccagtggcgtagccaccttctttgaaagcatcaaagagatccttctccggcagagtggagtaaaggtggaatctgtggatcatgactcctgtgtgcatggcccatgtcagaatggagggagctgtctacgaagattggctgtgagctccgtattaaaaagccgtgagagtcttccagtcatcatcgtggcaaatgaacctctgcagcctttcttatgcaagtgtctgccaggatatgcgggtagctggtgtgaaatagatatagatgaatgtcttccatcaccttgccacagtggtggaacctgtcacaatttagtgggaggattttcatgcagctgcccagatggcttcactggtagggcgtgtgagagagatatcaatgagtgcctgcagagtccttgcaagaatggtgccatctgccagaattttccaggaagcttcaactgtgtttgcaaaactggatacacaggtgtctttggaaaacactgcgagttgaacagttatggatttgaggagttatcatacatggaatttccaagcttggaccccaataacaactatatttatgtcaaatttgccacgattaaaagtcatgccttattgctttacaactatgacaaccagacaggcgaccgggctgagtttttggcccttgaaattgccgaagaaagactaagattctcttataatttaggcagtggtacatataagctcaccaccatgaagaaggtgtcagatggacattttcacactgtgattgccaggagagcaggaatggcagcctccttaactgtggactcctgttctgagaaccaagagccaggatattgtactgtcagtaatgtggcagtttcagatgactggactcttgatgttcagccaaatagagttacagttggaggtatcagatctctagaaccaatccttcagagaagaggacacgtggaaagccatgattttgttgggtgtataatggagtttgcagtcaatggaaggcctctggaacccagccaagctttggcagcacaaggcatcctagatcagtatggcgattttatttcttactgttttaaagaaaaaaaatgcaaaaaagtatgcttcactgttactcctgacactgccttatcattagaaggcaaagggcgcttggactaccacatgagtcagaatgagaagcgggaatatttgttaaggcaaagcttacgaggtgccatgttggagccttttggtgtgaacagtctggaagtaaaatttaggaccagaagcgagaatggcgttttaatccatatccaagaaagcagcaattacactactgtgaagattaagaatggcaaagtatattttacatccgatgcaggaattgctgggaaagtggagagaaatattcctgaagtatatgttgcagacggccactggcacacttttctaattgggaaaaatggaacagcaacagtattgtctgttgacagaatatataacagagatattatccaccctactcaggacttcggtggccttgatgtgcttactatatcacttggaggaattccacccaatcaagcacatcgagatgcccaaacagcaggttttgatggctgcattgcttctatgtggtatggtggagaaagtcttcctttcagcgggaagcatagcttggcctccatctcaaaaacagatccctcagtgaagattggctgccgtggcccgaacatttgtgccagcaacccctgctggggtgatttgctgtgcattaatcagtggtatgcctacaggtgtgtccctcctggggactgtgcctcccacccgtgccagaatggtggcagctgtgagccaggcctgcactccggcttcacctgtagctgcccagactcgcacacgggaaggacctgtgagatggtggtggcctgtcttggcgtcctctgtcctcaggggaaggtgtgcaaagctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaggagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccagaatgcccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtga

SEQ ID NO: 10467 - DNA, 16123 bp, Homo sapiens
gggagccaggaccatggacttagcaccagacagggctactggccgcccgtggctcccgttgcacactctatcagtatctcagctccttcgagtgttttggctactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccgcagtaccagctcctggttgaggtggaggacaagggtgagcctaagcggcggggctaccttcaggtaaacgtgactgtgcaagacattaatgacaaccccccggtttttggcagttctcactaccaggcgggggtgcctgaggacgcggttgtgggttccagcgtcctccaggtggcggcggcggacgcggacgagggcaccaacgcggacatccgctatcgcctgcaggacgaggggacccccttccaaatggaccctgagacgggacttatcacggtgcgggagcccctggacttcgaagctcggcgccaatactcgcttacggtgcaggcgatggacagaggcgtgccttccctcactgggcgcgccgaggcgctgattcagctgctggacgtgaatgacaatgacccggtagtgaagttccgctacttcccggccacctcgcgctacgcctcggtagatgagaatgctcaagtgggcaccgtggtggctctgctcaccgtgacggacgcagattctcccgcggccaacgggaacatctccgtgcaaattctcgggggcaatgagcagcgccactttgaagtgcaaagcagcaaagtgccgaacctgagcctaatcaaggtggccagcgccttggaccgcgagcgcatcccttcctacaacctcacagtttccgtctctgataactacggggcgccccctggcgcagcagtccaggcgcgctcttctgtggcaagcctggtgatttttgttaatgacatcaatgaccatcctcctgtcttttcacagcaagtgtacagagtgaacctgagcgaggaggcgcctccgggaagctatgtgagtgggatatctgccactgatggcgactctggtctcaatgctaatctgcgttacagcattgtctctggcaatggactgggatggttccatatcagtgaacatagcggcctcgtgaccactgggtcctctgggggcctggaccgtgaacttgcttcccagattgttctgaatataagtgcccgggaccagggagttcaccccaaggtgtcctatgcccagcttgtagtaactctcctagatgtgaatgatgaaaagccagtatttagccagccagaagggtatgatgtgtctgtggttgagaatgccccaacagggacagaactgttgatgctcagggcaactgacggggacctgggtgacaacggaacagtgcgcttctccttacaagaggcagagactgaccggaggtccttccgtctggatcctgtgtctgggaggttgagtactatttcctccttggacagagaagagcaagccttctactccctgttggttctggccacagatctgggctcccctccccagtcatcaatggctcgcataaatgtgagtcttctggatataaatgataacagccctgtcttctacccggtccaatactttgctcacattaaggagaatgagcctggaggtagctacatcaccactgtgtctgccactgacccagacttgggtaccaatggtactgtcaaatatagcatatctgctggggacaggtctcggtttcaggtcaatgctcagagtggggttatttctacaagaatggccctagacagagaagaaaaaacagcttatcagttgcaaatagtagctactgatggtggcaatttacaatctcccaaccaggcaatagtaaccatcactgtattggacactcaagacaacccacctgtattcagtcaggttgcctacagctttgtggtttttgagaacgtggcgctgggatatcatgtgggtagtgtgtctgcatccaccatggatctcaattccaacatcagttatctcattactactggggatcagaaaggtatgtttgctatcaaccaggtcactgggcagcttaccacagcaaatgtgattgatagagaagagcaatccttttatcagctgaaggtagtggccagtgggggcacagtgactggagacactatggttaacataacagttaaggatttgaatgacaactctccccatttccttcaggcaatagagagtgtaaatgtggtggagaattggcaggcaggtcacagcattttccaggccaaagctgtggaccctgatgaaggtgtcaatggcatggtactctatagtctgaagcaaaaccccaagaacctgtttgctatcaatgaaaagaatggcactattagtctgcttgggcccctggatgttcatgctggctcctaccaaatagagatcttggcatctgacatgggtgtcccacagctctcctctagtgtcatcttaacagtttatgtccatgatgtaaatgacaattcaccagtgtttgaccaactctcttatgaagtcaccctttctgagtcagaacctgtgaattctcgattctttaaagtacaagcttctgataaggattcaggagcaaatggtgaaattgcatacaccattgctgaaggaaatacaggggatgcttttggcatattcccagatggtcaattgtatataaaaagtgaactggaccgtgaacttcaagacagatatgttttaatggttgttgcttctgacagagcagtggaaccccttagtgctactgtgaatgttactgtaattttagaagatgtaaatgataacagacctctttttaacagtaccaattacacattttacttcgaagaagagcagagggctgggtcgtttgtgggcaaagtaagtgctgtagataaagactttgggccaaatggagaagtaaggtattcttttgaaatggtgcagccagattttgagttgcatgccatcagtggggaaattacaaatactcatcagtttgacagggagtctcttatgaggcggagagggactgctgtgtttagctttacagtcatagcaacagatcaggggatccctcagcctctcaaggatcaggccactgtacatgtttacatgaaggatataaatgataatgctcccaaatttttaaaagacttttaccaagctacaatatcagaatcagcagccaatctgacacaagtgttaagagtatctgcctcagatgttgatgaaggtaataatggacttattcactattctataataaaaggaaatgaagaaagacagtttgctatagacagtacctctggtcaggtaacactaattggcaaattagactatgaagcaacacctgcctattcccttgtaattcaagcagtggattcagggacaatccccctcaattcaacgtgtactttaaatattgatattttagatgaaaatgacaataccccttctttccctaaatcaacactctttgttgatgttttggaaaacatgagaattggtgaactcgtgtcctctgttactgcaactgattccgattcaggtgacaatgctgatttatattacagtattactgggactaacaaccacggaacttttagcattagcccaaacactgggagtatttttcttgccaaaaaactggactttgaaacacagtctttgtataaattaaatataacagcaaaagaccaaggaagacctcctcgttcatctacaatgtcagtggttattcacgtgagggactttaatgacaatcctcctagctttcctcctggagatattttcaagtctattgttgagaacattcccatcggtacatctgtcatttcagtgactgcacatgaccctgatgcagacattaatggtcaactatcctacacaatcattcaacagatgccaagaggcaaccactttaccatagatgaagtcaaagggactatatatactaatgctgaaatagatcgggaatttgctaatctctttgagttgactgtaaaagccaatgatcaagctgtgccaatagaaactagacggtatgctttgaagaacgtgaccattttggttacagacctcaatgacaatgtcccaatgtttatatcacaaaacgcccttgctgcagacccatcagctgtgattggttccgttctgacaacaattatggctgctgacccagatgaaggtgctaatggagaaatagagtatgagatcatcaatggggacacagacaccttcattgttgatcgttatagtggagacctgagagtggcttcagcgttggtgccttcacagttgatctacaatctcatagtttcagcaacagaccttgggcctgaaaggaggaaatcgaccactgaattgaccatcattcttcagggccttgatggacctgtttttactcaacccaaatatataactattttgaaggaaggagaacccattggcacaaacgtgatatcaatagaagcagctagccccagaggatctgaggccccagtggagtattatattgtttcagttcgttgtgaagaaaaaactgttggacgcctctttactattggacgacatactggtataattcagaccgcagccattctggaccgggagcaaggagcatgtctttacctggtggatgtttatgccatagaaaaatcaactgcttttcccagaacacagagagcagaggtagaaataacacttcaggatatcaatgacaatccaccagtatttccaacggacatgctggatctcacggtagaggagaacattggagatggctctaagattatgcagctgacagccatggatgctgatgagggtgcaaatgctctcgtcacatacactatcattagtggagctgatgatagttttcgcatcgacccagaatccggagatctgatagcaaccaggcggttggacagggaacgccgctccaaatattcactgctagttcgtgctgatgatggtcttcagtcctcggatatgagaattaatatcactgtcagtgatgtgaatgaccatacacccaaattttccagacccgtgtactcttttgacattcctgaggacacaatccctggttctttggtagcagccattttagccacggatgatgactctggtgtgaatggagaaattacatatattgtgaatgaagatgatgaagatggcatctttttcctgaatcctattactggggtctttaatttgactcgattattagattatgaagtacagcaatattatatcctcactgttcgagcagaagatggtgggggacaatttactaccatcagagtttatttcaatattctagatgtaaatgataatccacctattttcagcttgaattcatacagcacatctttaatggagaatctacctgtgggatctactgttcttgtgtttaatgttactgatgcagatgatggcatcaactctcaattgacttatagcattgcttcaggtgatagccttgggcagtttactgttgacaagaatggtgtactcaaagtcctaaaagctttggatcgggaaagtcagtccttctacaacttggttgttcaagtgcatgacctgccacagattccagcctccagattcacaagcactgctcaagtctccattattttgttggatgtaaatgataacccaccgacatttctttcccctaaattgacatacattccagaaaatacacctattgatactgttgttttcaaagctcaagcaactgacccagatagtggcccaaacagctatattgagtacactctgctgaaccctttgggaaacaagttcagtattgggaccattgatggtgaagtgaggctcactggagaactggacagagaagaagtttctaattatactctaacagtggtggctacagacaaaggtcaaccatctctctcttcatctacagaggttgtagttatggtacttgacatcaatgataacaaccccatctttgcacaagctttgtataaagtggagattaatgaaaacacacttactggaacagatataatacaagtgttcgcagcagatggagatgaaggcacaaatggacaggttcgctatggcattgttaatggtaataccaatcaggaatttcggatagactctgtcacaggtgccatcactgtcgctaaacctttggatagagaaaagacccctacctaccatttaactgttcaggcaacagatcgaggcagcacacccagaactgatacctccacggtcagcattgttctactggatattaatgactttgttcctgtatttgagctatctccatattctgtaaatgtccctgagaatttagggacactacccagaacaattcttcaggtggtggcaagagatgatgatcgaggatctaacagcaaactctcatatgttctgtttggtggtaatgaagacaatgcttttactctctcagccagtggagaacttggagtaacacagagtctggatcgggaaacaaaagagcgctttgtcttaatgattacagctacagattcaggatcccctgccttgactggaactggaacaatcaacgtcatagtagatgatgtcaatgacaatgtccccacatttgccagtaaagcgtatttcacaacaattcctgaggatgcaccaactggaacagatgttttattggtaaatgcctcagatgctgatgcttcaaagaatgcagttataaggatcatcggtggaaactctcagttcacgatcaacccatcgacaggacaaatcatcaccagcgcattgttagatagggaaacaaaagataattatactttggtagtggtctgcagtgatgcgggatccccagagcctctttccagttccaccagtgtgcttgtcactgtgactgatgtcaatgacaatccaccaagatttcagcatcacccatatgtcactcacatcccatctcctactcttccaggttcctttgtctttgcggttacagtcacagatgctgatattggaccaaattctgaactgcattattctctttcgggtagaaattctgaaaaatttcacattgacccactgaggggagccattatggccgccggaccactaaacggagcttcagaagtgacattttctgtgcatgtaaaagatggtggctcatttccaaagacagattctacaacagtgactgttagattcgtgaataaggccgatttccctaaagtgagagccaaagaacaaacgttcatgtttcctgaaaaccaaccagtcagctctcttgtcaccaccatcacaggatcctctttaagaggagaacctatgtcatattatatcgcaagtgggaatcttggcaatactttccagattgatcagttaacagggcaggtgtctattagtcaacctctggattttgaaaagatacaaaaatatgttgtatggatagaggccagagacggtggtttccctcctttctcctcttacgagaaacttgatataacagtattagatgtcaatgataatgccccaatttttaaggaagacccatttatatctgaaatattggaaaacctttcccctcgaaaaatacttactgtttcggcaatggacaaggacagtggacccaatggacagttagattatgaaattgttaatggcaacatggaaaatagtttcagtatcaatcatgctactggtgaaattagaagcgttagacctttggacagggaaaaagtatctcattatgtcctaaccataaaatcatcagacaaagggtccccgtctcagagtacttcagtaaaagtcatgattaacattttagatgaaaatgataatgcccctaggttttctcagatatttagtgcccatgttcctgaaaattcccccttaggatacacagttacccgtgtcacaacttctgatgaagacattgggatcaatgcaattagtagatattctataatggatgcaagtcttccatttacaattaatcccagcacaggggatattgtcataagcagacctttaaatagggaagatacagaccgttacagaattcgagtttccgcacatgattctgggtggactgtaagtacagatgtcacaatatttgtgacagacatcaatgacaatgctccaagatttagcagaacttcctattatttagattgccctgaacttactgagattggctccaaagtaactcaggtatttgcaacagatcctgatgagggatcaaatggacaagtgttttatttcataaaatcccaatcagaatatttcaggattaatgccaccactggagagattttcaataaacagatcttaaaataccaaaatgtcactggcttcagtaatgtgaatatcaacaggcatagttttatagtgacatcttcagatcgaggtaaaccttccttaattagtgagacaacagttaccatcaatatagtggacagtaatgacaatgcacctcaatttcttaaaagtaaatatttcactccagtcaccaaaaatgttaaggttggtacgaagttaatcagagttacagcaatagatgacaaagattttggactgaattcagaagtggagtatttcatttctaatgataaccatttaggaaaatttaagttggacaatgatacggggtggatttcagtagcatcctccctgatttctgacttgaaccaaaacttttttatcacagtcactgcaaaggataagggaaaccctccactttcttcccaagcaactgttcacataactgtcactgaggaaaactaccatacacctgaattctctcaaagccacatgagtgcaaccatccctgagagccatagcattgggtccattgtcagaactgtttctgcaagagatagagatgcagcgatgaatggcttgattaagtacagcatttcttcaggaaatgaagaaggcatttttgcaatcaattcttctacaggtatattaacactagccaaagctcttgattatgagctatgccagaaacacgaaatgacgattagtgctatagatggaggatgggttgcaagaactggttactgcagtgtgaccgtaaatgtgattgatgtgaatgataattctccagtattcctctctgatgactatttccctactgttttggaaaatgccccaagtggaacaacagttatccacctaaatgcaacagatgctgactctggaacaaatgctgtgattgcgtatactgtacagtcatctgacagtgacctctttgtcattgaccctaacacaggagtcataaccactcaaggcttcttggattttgaaaccaagcagagctaccatcttactgtgaaagccttcaatgtccccgatgaggaaaggtgtagctttgccactgttaatatacaattaaaagggacaaatgaatatgtgccccgttttgtttccaaactttactattttgaaatctcagaagcagctcctaaaggtactattgttggagaagtgtttgctagcgaccgtgatttgggcactgatggggaggtacactatttgatttttggtaatagtcgaaagaagggtttccagatcaataagaagactggacagatttatgtttctggaattcttgatcgagaaaaagaagaaagggtgtctttgaaggtattggccaagaactttggcagcattagaggtgcagatatagatgaggtcactgtaaatgtcaccgtgcttgatgcaaatgacccacccatttttactctaaacatctacagtgtgcagatcagtgaaggggtcccaataggaactcatgtgacctttgtcagtgcctttgactcagactccatccccagctggagcaggttttcttacttcatcggatcagggaatgaaaatggtgccttttctattaatccgcagacaggacagatcaccgttactgcagaattagatcgagaaacccttcccatctataatctctcagttttggctgttgattcagggaccccctcagctacaggtagtgcctctttattagtcaccctggaagatataaatgataacgggcccatgctgactgtcagtgaaggagaagtcatggaaaacaaacggccaggcactttggtgatgacccttcagtccactgaccctgatctccctccaaatcaaggtccctttacttattacttgctgagcacaggtcctgccaccagttatttcagtctgagcactgctggagttctgagcacaaccagagagattgacagagagcagattgcagacttctatctgtctgtggttaccaaggattctggtgttcctcaaatgtcttccacaggaactgtgcatatcacagttatagaccaaaatgacaatccttcacagtctcggacggtggagatatttgttaattattatggtaacttgtttcccggtgggattttaggctctgtgaagccacaggatccagatgtgttagacagcttccactgctcccttacttcaggagttaccagcctcttcagtattccagggggtacttgtgatctgaattcccagccaaggtccacagatggcacgtttgatctgactgtccttagcaatgatggagttcacagcacagtcacgagcaacatccgagttttctttgctggattttccaatgccacagtggataacagcatcttacttcgtctcggcgtaccaacagtaaaggacttcttgaccaaccactatcttcattttttacgcattgccagctcacagctgacaggcttagggactgctgtgcaactgtacagtgcatatgaagagaacaatagaacgtttcttttggcagctgtgaagcgaaatcataatcagtatgtgaatcccagtggcgtagccaccttctttgaaagcatcaaagagatccttctccggcagagtggagtaaaggtggaatctgtggatcatgactcctgtgtgcatggcccatgtcagaatggagggagctgtctacgaagattggctgtgagctccgtattaaaaagccgtgagagtcttccagtcatcatcgtggcaaatgaacctctgcagcctttcttatgcaagtgtctgccaggatatgcgggtagctggtgtgaaatagatatagatgaatgtcttccatcaccttgccacagtggtggaacctgtcacaatttagtgggaggattttcatgcagctgcccagatggcttcactggtagggcgtgtgagagagatatcaatgagtgcctgcagagtccttgcaagaatggtgccatctgccagaattttccaggaagcttcaactgtgtttgcaaaactggatacacagggaaaatgtgtgaatcttcagtcaattactgtgaatgcaacccctgctttaatggtggttcctgccaaagtggtgtggattcttattattgtcattgtccatttggtgtctttggaaaacactgcgagttgaacagttatggatttgaggagttatcatacatggaatttccaagcttggaccccaataacaactatatttatgtcaaatttgccacgattaaaagtcatgccttattgctttacaactatgacaaccagacaggcgaccgggctgagtttttggcccttgaaattgccgaagaaagactaagattctcttataatttaggcagtggtacatataagctcaccaccatgaagaaggtgtcagatggacattttcacactgtgattgccaggagagcaggaatggcagcctccttaactgtggactcctgttctgagaaccaagagccaggatattgtactgtcagtaatgtggcagtttcagatgactggactcttgatgttcagccaaatagagttacagttggaggtatcagatctctagaaccaatccttcagagaagaggacacgtggaaagccatgattttgttgggtgtataatggagtttgcagtcaatggaaggcctctggaacccagccaagctttggcagcacaaggcatcctagatcaatgccctaggctggaaggcgcttgtactcgcagcccatgccaacatggtggcacatgtatggattactggtcatggcagcagtgtcattgcaaagagggactcactgggaaatactgtgaaaaatctgttactcctgacactgccttatcattagaaggcaaagggcgcttggactaccacatgagtcagaatgagaagcgggaatatttgttaaggcaaagcttacgaggtgccatgttggagccttttggtgtgaacagtctggaagtaaaatttaggaccagaagcgagaatggcgttttaatccatatccaagaaagcagcaattacactactgtgaagattaagaatggcaaagtatattttacatccgatgcaggaattgctgggaaagtggagagaaatattcctgaagtatatgttgcagacggccactggcacacttttctaattgggaaaaatggaacagcaacagtattgtctgttgacagaatatataacagagatattatccaccctactcaggacttcggtggccttgatgtgcttactatatcacttggaggaattccacccaatcaagcacatcgagatgcccaaacagcaggttttgatggctgcattgcttctatgtggtatggtggagaaagtcttcctttcagcgggaagcatagcttggcctccatctcaaaaacagatccctcagtgaagattggctgccgtggcccgaacatttgtgccagcaacccctgctggggtgatttgctgtgcattaatcagtggtatgcctacaggtgtgtccctcctggggactgtgcctcccacccgtgccagaatggtggcagctgtgagccaggcctgcactccggcttcacctgtagctgcccagactcgcacacgggaaggacctgtgagatggtggtggcctgtcttggcgtcctctgtcctcaggggaaggtgtgcaaagctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaggagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccagaatgcccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtgaagtttatgtactggcactataaaatataaaaacaagaaataatactcaaaccattgtaaagttgctgactaggttgggtcacatttgaaaaacaggccagtatggactagtggtggagggaaaactttaaaaataataaccacaatgctgctgaaacagactcacaacaactcttaatttaaacatgtgtggttgaatttatttccctgcatgcattgtgttttgtaactagttatgtggcatgcagcatttggaaaatttttcttatttaccagtgtttgatttgtgatttttaaaaattgatacctttaccattgcagaaaagaacttgtgctttcccagtggcgtatgtgtattgtttcaactgtattattataattatattttgcattgcaagattcttgatgttaaaccaatccttgtaaagtgtaaaaaggaaccctcctatcgtggaatgaaagattaagtatattaacacttttcagaatgatagtttctgtatttgatgttgctcagaaatgtctcagtatttgagtaagttttacatgacagtgggtactgaaattaagtcattttgttcagcactttaacgctttcttatagaattgtcttaaaacttctggatccttgagcaaatgattatagtctcctgactttcatgaggcttccattaggaacagaatgattgcatgttgtccccagaacactgccaccttgctatgcgaatgatgttctcagcagcacttctaagaaacactcttaaaagttatttattgaaaatttttcgtatgcttttaatattttaaagaattgacctaaggaaagcttatgattggacttattttccaaccagataacatttactctaagtacccagtttttataatttatatgaaatcagatttcaacacttactttgtcattttgtagatcatttttttaaaatactgtgtaaaaactttttttacacctaagctgtgtttttgatactgatattttcctatgctgaatagttttcttactttcagggaaggtaagaaaatactttttttatatttgttacttatgtaacattcatatttttctcattttgatatttgtaacatactgtatgctttctacttgtaaatgtcaacaatagaattaaaatatttatttaaaata

SEQ ID NO: 10468 - DNA, 2431 bp, Homo sapiens
tcccgggatgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctggcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaa

SEQ ID NO: 10469 - DNA, 1537 bp, Homo sapiens
cccgggatgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttggg

SEQ ID NO: 10470 - DNA, 2094 bp, Homo sapiens
agtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgtgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaaca

SEQ ID NO: 10471 - DNA, 1195 bp, Homo sapiens
gcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgctgccggcccctgcct

SEQ ID NO: 10472 - DNA, 1983 bp, Homo sapiens
agacactggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggtccaaagtttgcctcaaagacccctcggccggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacaggtttgaggaagcgatgaaggaggctcatgctgtagatcaaaagcttgcagagaagcaggaagatgaagccaccctggaaaataaatggcccttccttggggttcctttgacagtcaaggaagctttccagctacaaggaatgcccaattcttctggactcatgaaccgtcgtgatgccattgccaaaacagatgccactgtggtggcattactgaagggagctggtgccattcctcttggcataaccaactgtagtgagttgtgtatgtggtatgaatccagtaacaagatctatggccgatcaaacaacccatatgatttacagcatattgtaggtggaagttctggtggtgagggctgcacactggcagctgcctgctcagttattggtgtgggctctgatattggtggtagcattcgaatgcctgctttcttcaatggtatatttggacacaagccttctccaggtgtggttcccaacaaaggtcagtttcccttggctgtgggagcccaggagttgtttctgtgcactggtcctatgtgccgttatgctgaagacctggcccccatgttgaaggtcatggcaggacctgggatcaaaaggttaaaactagacacaaaggtacatttaaaagacttaaaattttactggatggaacatgatggaggctcatttttaatgtccaaagtggaccaagatctcattatgactcagaaaaaggttgtggttcaccttgaaactattctaggagcctcagttcaacatgttaaactgaagaaaatgaagtactcttttcagttgtggatcgcaatgatgtcagcaaagggacatgatgggaaggaacctgtgaaatttgtagatttgcttggtgaccatgggaaacatgtcagtcctctgtgggagttgatcaaatggtgcctgggtctgtcagtgtacaccatcccttccattggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggcctttcaactttgcttacacaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaatcaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctggaa

SEQ ID NO: 10473 - DNA, 546 bp, Homo sapiens
tattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgtttt

SEQ ID NO: 10474 - DNA, 2478 bp, Homo sapiens
ctaattcttgaaataagtatgcccacaaactgtaatttaagacagaataggtatgcttctcatgttttaattcagttgaatttcagaagatctcaggaatgtacagaacgagaattaagaattaattaataagaattaattaattgcttgacatagttaggtgatttcctgaactttaagcttccacatcacagtatgaagttggttctaagataagaaatataataaattctcgcccaaggacagacctgaatctctagctgcctagaggctgactcaactgaaatcatggcgtttgacagcacttggaaggtagaccggagtgaaaactatgacaagttcatggaaaaaatgggtgttaatatagtgaaaaggaagcttgcagctcatgacaatttgaagctgacaattacacaagaaggaaataaattcacagtcaaagaatcaagcacttttcgaaacattgaagttgtttttgaacttggtgtcacctttaattacaatctagcagacggaactgaactcagggggacctggagccttgagggaaataaacttattggaaaattcaaacggacagacaatggaaacgaactgaatactgtccgagaaattataggtgatgaactagtccagacttatgtatatgaaggagtagaagccaaaaggatctttaaaaaggattgagcattattcttggcgcacagtccaaaatacaaattggacagaagatctatattgtaccagaactatttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcgtccatgttgctttatatgtagccttgccttttaaaagaaaaagtatgtgaatatgaattgacagactgttttcgtagagagagggtcttactctttcactcaggctggaatgtagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcaaccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccacgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagatatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattgtattttagcagggtacatattaggggatggagagggggtacaatttttaagcatttgcagctgcaactctatagacttttgacaaattctttttcacactgatgtagataacagcttaacatttacatagttcttactacttgccacacactgttctaagtggtatatacatatgacatatatattaaaatgtaggaagaaaaatgtttgagtacctgatgaaaatgaatagagagtatgtaatctttgaaagctgaatactgcgtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatcta

SEQ ID NO: 10475 - DNA, 725 bp, Homo sapiens
gccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataa

SEQ ID NO: 10476 - DNA, 851 bp, Homo sapiens
ggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaata

SEQ ID NO: 10477 - DNA, 756 bp, Homo sapiens
gcgacaacaaaacagattactttgaagggactagaaggaggacacagggtcctggaggaaggcagctggcaagttacagagcagaaagactttgcacctctggctccagggagctcacaggcaggggctggtccagcccagaggcgatgaagacagtgacgatgatgatggtggtggagatgcaggcgctgactcaggttctgagagctgtgttgtctgcgtgcacatgggtgagccggaaaggagacctgcagagaatgaaacagacacataaaggaaagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagacgctgctcgctccagaa

SEQ ID NO: 10478 - DNA, 663 bp, Homo sapiens
cattgcagactttgcacctctggctccagggagctcacaggcaggggctggtccagcccagaggcgatgaagacagtgacgatgatgatggtggtggagatgcaggcgctgactcaggttctgagagctgtgttgtctgcgtgcacatgggtgagccggaaaggagacctgcagagaatgaaacagacacataaaggaaagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagacgct

SEQ ID NO: 10479 - DNA, 572 bp, Homo sapiens
gaagaagtggggtgacttaggggctgagcctcagcaactgggagagtttataagctgggatagcagacccctcagcaccacccattctcctcatccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggaca

SEQ ID NO: 10480 - DNA, 2086 bp, Homo sapiens
ccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaaaacaggggaaacaaaaagatcccagttaattttcttcttcagctcaacttctttgattgtagaaaaagagaaaaattcatgtgtagttaaaaaaataaaagttgccattgatttgcctaaaactgtgtcaaaagattttttgtaggataactatggatgtctctcaaataaaatttaatataaagcccataatcactgaaatatataaagataattgctattataagagaatctcagacagatgactttatagctcctgtaataagagatctttaaacagtttatattttaatttataaagttacacaagttctgggcagataatttagaatataacagaaaagtataacaaaaaaattaaaatcccctctgatttctcatcagtgataacccttttttttttttttttttgagataaagtcttgctgtgtcacccagactggagtgcagggggtgcattcttggctcactgcaacctctgcttcatgggctcaagcgattctacaacctcagcctcctaagtagctgggaccacaggtgcaagccaccaacgccgggctaatttttttgtatttttgtagagatgggatttcgccatgttgcccaggctggcctacagctcttgagctcaaagtgatgctcccgcctgctgcctcggcctcccagagtgctgggattacaggcctgagccaaggctcccagcccccaaagagaaccattttgatgttacttctttccagtttttttctcgaatgcataatatgccttttaaacatatatattcaatactaggtagacatgaaaaatatttttttcaatcagcctcttcttacttactaggaattatctgtaaaagaggatttattagtgtcctaaggctgccacaacaaagtaccacaaacttggtggcttaaaacaacagaaatgaattttctcagttctgaaagctggacgcctgagatcaaggcgaccctagtgttgccatccttctgcgggccccctcccttgcttcttcctacttcccggatggctcctggcaatcattgaggttgttgggcttacagttgttattactctgatccatttctgactccatctttacaagactttttcctctgtttttgtcctaaattgatcaaatataaaataattaacaaataatttatctaatgatggagtagtatcacaaactaggagaaatattatgccttcaccaagccttcctcagacactttttgtgtgacctgcaatggtatattgatgatactgacataggtgggtaggctcattcaattttggaggagggtgtgagaatgctttacatagtccttgtacgatgacagcagagaaagttttgttgtttaagaatggggactcatgtttccttctccccttgactactgcaatcagcactgttctgcattgagatattcatgtttctgtggagatggaggtggggagcagagggacagttttcctttcatgttaaaggatatttgctcacatttttttggcaacaatcaataaaagaaaggactcatttctaaaa

SEQ ID NO: 10481 - DNA, 1026 bp, Homo sapiens
tttctcaggcataagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtcccccccccccttttttttataaacaagtgaatacattttataatttcttttggaatgtaaatcaaatttgaataaaaatcttacacgtgaaa

SEQ ID NO: 10482 - DNA, 4523 bp, Homo sapiens
cattcactcctgcagcgcggccccgcacccagggcctgcactagaaccgctgttcctaccgcggcgccccctgggagccaacgccgcgatgcccgcctgacgtcaggaagtcgaatccggcggcgacgcctttagggagcccgcgagggggcgcgtgttggcagcccagctgtgagttgcccaagacccaccgggggacgggatctcgctccccgcgccacgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 10483 - DNA, 2079 bp, Homo sapiens
aatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagagacctctagctacagaaaagttctccaagtctgcactcgacccaggaagtccatctggcttcacctctcacttcaacttgggtacagccttctggcgggcaggaggatggcctttggtgcgaacactgccggagtccagggggctggctccctcacctttcatcttctcccggcacttgcaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttc

SEQ ID NO: 10484 - DNA, 1690 bp, Homo sapiens
gtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacacta

SEQ ID NO: 10485 - DNA, 1725 bp, Homo sapiens
gcagacgaaacaggcaccaacgctggagcttcccgcagtgtgatttggggccgggaatgccgcggcggggacggcgattggtccgtatgtgtggtgccaccggccgccggctccgccccggcccccgccccacacgccgcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactca

SEQ ID NO: 10486 - DNA, 3916 bp, Homo sapiens
caggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcataaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaag

SEQ ID NO: 10487 - DNA, 2964 bp, Homo sapiens
agagacctgaggctcggggctgcagatggaatgcacggcagggaggcgggaccctttgtttgtgtgtgcgtgttgttggcctccatccccactccccagactccacttctccaggcctctctcccgccttttcatcccgcatccgcaggacacccaatcaccgggcaacaggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 10488 - DNA, 3630 bp, Homo sapiens
attcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcgggcggcggggaacgcgggaggatgtggaacccgaggcggggggagccggaggggcgggcagaggaggtgtcgaggccctgagctcccggggagtttttactggaggcaaaagtccatagcgggagggctgagggaggggcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 10489 - DNA, 1703 bp, Homo sapiens
aaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccagtgagcgcggggctgcggggaggcggggagacccacagcgggagggaagtggccgctatcccactgggcagaatgcagaatgtgggggccacctctttgtctctctgacaaggtctctgcccaatatagagcaaggctcccagccagccccgctgaggtcaggagaggggctcccctattccatctccctgagggtcatcctgtgcccctcatgctgtgccacttggtcatagtggttaccacctccctccatgtgggcctgggactttgtagttatggagcctgcacacgcacctcatgaccctgtgaggctagcagggcagggctacgtagcttgcctggaacatcggccgagggactgccctgctgccccttgtccttgcttcacctcttgtcactgtttttttttttttttattaaaaaataaaaaatgta

SEQ ID NO: 10490 - DNA, 1779 bp, Homo sapiens
cgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcgccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgataccctcacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 10491 - DNA, 1834 bp, Homo sapiens
gctcttcgcttccctcggggtcttgctcggacctcggccaccgcctgggatccccaggactcgtgcgtgcagcatgggcggcgtcggggagccgggaccgcgggagggacccgcgcagccgggggcgccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccag

SEQ ID NO: 10492 - DNA, 3753 bp, Homo sapiens
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgcc

SEQ ID NO: 10493 - DNA, 3645 bp, Homo sapiens
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgcc

SEQ ID NO: 10494 - DNA, 3324 bp, Homo sapiens
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgcc

SEQ ID NO: 10495 - DNA, 3612 bp, Homo sapiens
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgcc

SEQ ID NO: 10496 - DNA, 4386 bp, Homo sapiens
ctcctcctctcagcacctggcgcggcgctacgcggccctggccgccgaggactgcgccgctgctgcccgccgcttcctgctatcctcggccgccgccgccgccgccgctgccgcctcggcttcgtcgcccgcctcctgctgcaaagagttggggctggctgcggccgccgcctgggagcagcagggccgaagtctcttcctggccagcttggggccggtgcgcttcctggggccgcccgccgccgtgcagctcttccgggggccgacaccgtcaccggccgagctccctacgccccccgaaatggtgtgcaagcggaagggggccggggtccccgcctgcaccccctgcaagcagccccgcagccgctctgccctccgccctcttctcccacctccgaaggtgcccccaccgaagctggcggggacgctgtccgagccgggggcaccgcccccttgtccgcccagcagcagcatgaatgtggcgacgcggactgtcgggagtcccccgaaaacccctgcgactgtcacagggagccgccccccgaaaccccagacatcaaccagctgccgccgtccatcctgctcaagatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtcaacgaagtgacggtggaacagctggtgcagcagtacccccacatcaccttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtatttgtgtcttgtttgcatactgcataccaaaagtgcagttgtcatttgttcccaagtgagctggctttttttcttagaaattaaagattatgaaagccacaaactttttagtttttaacttcaaaggcttctttctctttaaaaaaaaattatttttaatatagagtcaaaaaattggatgtattattttgagcttctaattgctgccacttggagatgtccaagtaagaaggccttctttttacatgggatgaattgtgcacttctactgatgatgactacagcagaagtgatgttatacgtacaggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaacattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatactgaggtttgagtttcactttctttaagtctcacattgctaacatgacattagctgtaagaaacaagatagctttacatttgaatgccatttactgatttctaatgattctctttttttgtaaacaactgtttcctttgattatgtcaacatgtttctgatgtggcatttttgttttaatcccaatcggttaggaaaatctagtcagtaagcgccatgagtattcttcccataactaaatgggtttctaatttaatttgaagggaataaaatttgtgtaagaaaaaagctgtttaacattaataaactatatttcttcttacacattgaactgtatcattttcatatccacttccccaccactgaaatatcttatttcacaatattttaactgatttttaatccaaaactaatttataagacagtatgtatagtaatagtagcttgagtgaatatgcaaaagtttaatttttatatatgtcatactatattttaaatagttaaaaaagacaaaagaagggagagccatctatgatatagatggtaccatttcagttcaaagttgtaataacctttggagtgttacagtttggttgtcaaatggtttcagaatgtataattgatttttttaaatgttgcattgtttgaatctaaagtacagcactataacatgctttagcttgggggggtgggggtggggtggggacttgcacttattctctaaaatgttgactaatccagaaagcctgatgcaacataatctggaaaactgctttggtacatttgtagaaatccgtagaaataccatatccagcctcaaagcattaatctcaaaaaaaaaaaaaaaaaaaaaaaaaaacagccagaaaaaagcatcaccttgagtggtcctgtgatggttgttgaatgtgttctcattagatgctttgaaatgaggcttaaaataatttttctgggcaatatagagtttcttttttttgcttagaatgtcataaatacatgtgaacacgtttaatgcagggctttttattctctccaaaatgtcaacagtattttcagaataaagactatgaaatatattgctgtagtggaaaattctggtcctttgtctttaatgtctttttgagtggataaagaaaattcacccggtttgtagtttctatatttccgtgaatctttgaccttgcagtgggttgcaataaaagagaaacaaaa

SEQ ID NO: 10497 - DNA, 3773 bp, Homo sapiens
gatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtaagagttgactatcaagttgtttgctttctacatatcagtatagttaatagcttgatgtcatatcctctctccttctctatctccacccccgtgtattatatattatatatacattttatatgtatatatgcaattatagctatgcattgtttgcctgcttttgtaaactaatctgagattatctttgtatttccccacttaataatgaattttgtgcttaagtagaaagaaaaagtaatcatatacatagtcaactagagtttggcatcctattcataagtccatggaccaaaatgtaaaagattacatgacaaactgcaatttgcagggtctaaccgtaaaattgtattctgggtttcaagtttccagcaacagtaaaggtggaaagaacagtgccaaattggtttttcacaagtgtgtaattttggtactgaacatctatgtattctggccattcgggaccaacaaagggccagtaagggggtatgtgggaatttgcatctccccatacatcagatgccactcccagcacatgataagaagtggttccagaggtcctggtggaaggcctgtagaaccagccagggatgtgagcatgagtttaggaaatggtgtagcatttaacgtgggaccctttgaagactgagaaaacagataataaaaatctatactgacacctgtaatcccagcacattgggaggccaaggcagaaggatcacttgagcccaggaatttgagaccagcctggacaacatgggaaaaccctgtctctatccccctctcccccaacaaaaaaaaattagccaggcataatggcacacacctgtagtcccagctactcgggaagctaaggtgggaggatcacctgagctcaagaggccgaggttgcagtgagccgtgattgtgccgcaaccacctcagcctggatgacggagcacgactgtgtcccaaacaaacaaaaaaaacctatactggacaccaggcactccacaggtgttttcttctttgtttattccatgttttacctataacaagtctaagaaatagttatttgcattgtgaaggggagaaaatggaggctcagaaagaccagtcagtggccccaggatactctggcaagacttcatgccgggtctttggagtctgtatccagtgctgctggcacaacccagggggcagtctgtggccacggggactgcttcccttggaaaaggtccagttcagatacttgctcagaaagtgccgccatcttgtactaatttacacatgtgtgctacttttgtaaatggtgattaggaacaaatctagcaaaataatgtgaaactaaatagacacgccattcaaagggcatgcatcttctaaatgtagcaaatgtgggggcaaatgaagtatggcccaaagctcttgtgtcctttgtgattttttgttaattggctaattcttttctccaaacactttagaatcccaacttatacgagacctttgccagctagttatgtttagagaaatgttattatatattctcagcccagcccagaagcgacttactttgtaactaagcaacagcactgagatccggggcttgcgagtctcccacaaatctttccactaaccaacctaatgccgctgctaaccctgccactttaaaatgacttcttttaagacaagttaaagggtccaccataggcatagtcctctagaaacaggaatcaatgacagcagaactcctcagcttccagcagaaggaactgccacatgaatgctaactaaagctaccaaaatgtacacattcatacatatgtgtccgcagccattctcagaaattgtcatatttctaacctgtaatctttagatggttaagatcagctccatcttcggagatacactgtagaagttgtatgttacagttactacaggagaatgttattccagacatatttgctgaccagcattttgctgatttttagttaagaaatgggttattttctacccaaatgcaaattagtccaaaattaaatagagacagtattcagattagctgtatccctgagggttttagcccttttcctgggctgcctctgaatcctttctctaaccagagagccactctgagaacccattggctccagcacgacgccgtctggtcagagcctgctgcagtgcagcccagggagatgctggacccagccttgctgtctggcttcctcagacttaaagcagctcagagccaaacacgagaggctctgtgaggatggaagacagttccaaaccacacacaaagcacaagtaaagccttgcacagaaaagcctgcttgttggtttagttggatggaaatctaaagtagctattcagttttcagattttgtatcatgccatccatctccagattttaagttaccatcaagattcaaaggaagatatgagtaacaaagaaaagaaattagtagcaacggtatggtctgcggagagccagagttcaggttcagatctgggctttgcacttactagttgtgtcaccgcgggcagttactaacctctcagtgcctgttccctcgtttgcaaaatgaggatgatactagtacctatcttgtagaattgtgagcatgtgaatgagttaacatacataaagcacttagaataatgtctattatatataaaatgctctgttactgattagtcttatcatccatatcattatattaacctgtgttgtgatactggaattttccaatgagaaaaaaaaattatattgcctactatcccattttgaaagacaattaaaaagaaaggaaaaaa

SEQ ID NO: 10498 - DNA, 5188 bp, Homo sapiens
agagtcgcgggtgcgcgcgccggcggcggatccgcagttaaaatggtccgagcgggacccggcctttccccggccgctccgctgactgactgagccggctggccgggcccggactggtcgcctagccggcaggctcgctcgctccctccctcgcgtccccaaagctcgcgcccatcgttctcccggcttccctgggcaaagcatgtagcccccgtcgggcactccggcggcccgcagctgacgcccaccccccaccgtcgcgtgtgtgcccgtgtgtgcgtgtgtgtgcgcaggaagggcgacccctccgggggccgagccagcgagcggcctgccccgctgccgggagcccgcctctctgggtctccctccctcccgtcccggtccccctcctcggggccttctatatgggccaccttctctcgaaggagccgcgtaaccgcccgagccagaagaggcctcgctgttgcagttggtgccgccgccggcgccctctcctcaggctgccccgccggaccccagccaaggtgccccctcagccggcggcgccccggagccgggactgcttcttccgcgggccctgcatgctctgcttcatcgtgcacagtcccggcgcgcccgcccccgccggcccagaggaggagccgccgctctcgccgccgccgcgggacggggcctacgctgccgcctcctcctctcagcacctggcgcggcgctacgcggccctggccgccgaggactgcgccgctgctgcccgccgcttcctgctatcctcggccgccgccgccgccgccgctgccgcctcggcttcgtcgcccgcctcctgctgcaaagagttggggctggctgcggccgccgcctgggagcagcagggccgaagtctcttcctggccagcttggggccggtgcgcttcctggggccgcccgccgccgtgcagctcttccgggggccgacaccgtcaccggccgagctccctacgccccccgaaatggtgtgcaagcggaagggggccggggtccccgcctgcaccccctgcaagcagccccgctgcggcggcgggggctgcggcggcggcggcggcggcggtggcgggggagggcctgcggggggaggcgcttcgccgccccggccccccgacgccggctgctgccaggccccggagcagcccccgcagccgctctgccctccgccctcttctcccacctccgaaggtgcccccaccgaagctggcggggacgctgtccgagccgggggcaccgcccccttgtccgcccagcagcagcatgaatgtggcgacgcggactgtcgggagtcccccgaaaacccctgcgactgtcacagggagccgccccccgaaaccccagacatcaaccagctgccgccgtccatcctgctcaagatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtcaacgaagtgacggtggaacagctggtgcagcagtacccccacatcaccttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtatttgtgtcttgtttgcatactgcataccaaaagtgcagttgtcatttgttcccaagtgagctggctttttttcttagaaattaaagattatgaaagccacaaactttttagtttttaacttcaaaggcttctttctctttaaaaaaaaattatttttaatatagagtcaaaaaattggatgtattattttgagcttctaattgctgccacttggagatgtccaagtaagaaggccttctttttacatgggatgaattgtgcacttctactgatgatgactacagcagaagtgatgttatacgtacaggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaacattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatactgaggtttgagtttcactttctttaagtctcacattgctaacatgacattagctgtaagaaacaagatagctttacatttgaatgccatttactgatttctaatgattctctttttttgtaaacaactgtttcctttgattatgtcaacatgtttctgatgtggcatttttgttttaatcccaatcggttaggaaaatctagtcagtaagcgccatgagtattcttcccataactaaatgggtttctaatttaatttgaagggaataaaatttgtgtaagaaaaaagctgtttaacattaataaactatatttcttcttacacattgaactgtatcattttcatatccacttccccaccactgaaatatcttatttcacaatattttaactgatttttaatccaaaactaatttataagacagtatgtatagtaatagtagcttgagtgaatatgcaaaagtttaatttttatatatgtcatactatattttaaatagttaaaaaagacaaaagaagggagagccatctatgatatagatggtaccatttcagttcaaagttgtaataacctttggagtgttacagtttggttgtcaaatggtttcagaatgtataattgatttttttaaatgttgcattgtttgaatctaaagtacagcactataacatgctttagcttgggggggtgggggtggggtggggacttgcacttattctctaaaatgttgactaatccagaaagcctgatgcaacataatctggaaaactgctttggtacatttgtagaaatccgtagaaataccatatccagcctcaaagcattaatctcaaaaaaaaaaaaaaaaaaaaaaaaaaacagccagaaaaaagcatcaccttgagtggtcctgtgatggttgttgaatgtgttctcattagatgctttgaaatgaggcttaaaataatttttctgggcaatatagagtttcttttttttgcttagaatgtcataaatacatgtgaacacgtttaatgcagggctttttattctctccaaaatgtcaacagtattttcagaataaagactatgaaatatattgctgtagtggaaaattctggtcctttgtctttaatgtctttttgagtggataaagaaaattcacccggtttgtagtttctatatttccgtgaatctttgaccttgcagtgggttgcaataaaag

SEQ ID NO: 10499 - DNA, 3965 bp, Homo sapiens
gggaggggagctgggactcggacccgggactgagtgggccccgggcagaagctgagcaccctgcgcccaaggagcccccgttggcctgggggggctgagggactgagcctcccagagcaggacctccccctggaagggccgcgccgcagcccgtgggagggcctcgcccccggcgccccccatctccactcgccgccgtcccggcctccgccggagggaggggccgagcgccctcggggggccgtggaccccggcgttctgagcgttccgcgccccgcgccgcccggcccccccgccgccgatggccgccgacccgccgggagctgccgagaagggagagatggctcccgggacacgtgtgagccctcggcgttgctgacgcccccaatgtcgtcgagcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaaggtgggtggagacgcctgcctcctccgaggatcggacccaggcggcccgggcctgctgccccccagggttctgaatccgagccaggctttctcatcctgccaccctgggctccctcccgagaactgggagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggg

SEQ ID NO: 10500 - DNA, 3796 bp, Homo sapiens
aaactcatctccagccctccttcctatgacctctccaccctggggaactggccctccttcctagaccctgcttccccttgaaagcccccacccccgcctgcagtcgccgccctccaggcccctcccctggagcgctggagggccccttagccccatggatgggtatgaaagtccccggaaagggggaatctgggccctcggcgttgctgacgcccccaatgtcgtcgagcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaaggtgggtggagacgcctgcctcctccgaggatcggacccaggcggcccgggcctgctgccccccagggttctgaatccgagccaggctttctcatcctgccaccctgggctccctcccgagaactgggagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggg

SEQ ID NO: 10501 - DNA, 3312 bp, Homo sapiens
gcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggg

SEQ ID NO: 10502 - DNA, 1529 bp, Homo sapiens
aacgggcgtcgccggcgccgtgtgacttcgggctgtgggctcgctcgcggctcttcggccatggttttctcaaacaatgatgaaggccttattaacaaaaagttacccaaagaacttctgttaagaatgctgttcagcttgttgttaaattttacttggtctaatccagaatgtactaagtatgtacatagcattggtctggattctttttgtaatgtgaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctggtgagtctgagtttttctgacattattcacctgttaaagatgaaagagccctcccaccacaacaagaagctgtttgggttctctttctgtaagagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgc

SEQ ID NO: 10503 - DNA, 3847 bp, Homo sapiens
gggcggggcgcctggctggcgtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattcttgctccatgctgtccatatttatgatctttattaagaacctgtcaatcagtcatcaccaccttcattgtaaacttaggtgttcatggtggctggcccttccaaacaaccactcccccaaactgaagggccagagctcatgagaaacttaaaagtgaaacggcaaaagcaagatgtgttcccatgactaccaatacctttattaggcagttttagaagtgtttttaaggatatattatgtcagctgcattctaggaagagaagcagattatatatatatataatctccccataaacggacttagcacaattatcatcagagtaagcattaaagtcattttattgccttatgatatattccagtattccttggtctaaaaattgtgtggataccatagcagttagttaaatatacatttatacccactgtttgttgtggaagagatgatgggggaggaggactgatgcaggaagcaacttcaataaatgagcatataacagacttgcttcagtgattatgaattagtttagtttctattaaaaaaaattaacttaaggctggccacggtggttcatgcctataatcccagcacttggggaggccaaggcgggtggatcacctgaggtcaggagtttgagaccagcctggccaacacagtaaaaccccatctctactgaaaatacaaaaattagccgggcgtggtgctgggcacctgtaatctcagctactcgggaggctgaagcaggagaaatgctggaacccaggaggcggaggtggcagtgagccgagattgtgccattgcactccatccagcccaggagacaacagtgagactccatcatcatctcaaaacaaaacaaacaaacaaacaaaacaaaccaccagagccttctatacatgattgatttcttttgagccaggatacaacctatcatcagtcacagctattggacttgatgctcaatgatccatggcctcatttacaaaacaggagaacctcttgtaagaaaatcaggtttgcaggctgggcacggtggctcacgcctgtaatcccagcactttgggaggcagaggcgggcggatcgtgagatcaggagatcaagaccatcctggctaacacagtgaaaccccgtctctactaaaaatacaaaaaaaattagccgggcatagtggcgggtgcctgtagtcccagctactcaggagactgaggcagaagaatggcgtgaacccgggaggcagagcttgcagtgagccgagattgcgccactgcactccagcctgggtgacagagccagactccgtctcaaaaaaaaaaaaaaaaaagaaaa

SEQ ID NO: 10504 - DNA, 1618 bp, Homo sapiens
acaacgggcgtcgccggcgccgtgtgacttcgggctgtgggctcgctcgcggctcttcggccatggttttctcaaacaatgatgaaggccttattaacaaaaagttacccaaagaacttctgttaagaatgctgttcagcttgttgttaaattttacttggtctaatccagaatgtactaagtatgtacatagcattggtctggattctttttgtaatgtggacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctacttt

SEQ ID NO: 10505 - DNA, 2793 bp, Homo sapiens
accaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattcttgctccatgctgtccatatttatgatctttattaagaacctgtcaatcagtcatcaccaccttcattgtaaacttaggtgttcatggtggctggcccttccaaacaaccactcccccaaactgaagggccagagctcatgagaaacttaaaagtgaaacggcaaaagcaagatgtgttcccatgactaccaatacctttattaggcagttttagaagtgtttttaaggatatattatgtcagctgcattctaggaagagaagcagattatatatatatataatctccccataaacggacttagcacaattatcatcagagtaagcattaaagtcattttattgccttatgatatattccagtattccttggtctaaaaattgtgtggataccatagcagttagttaaatatacatttatacccactgtttgttgtggaagagatgatgggggaggaggactgatgcaggaagcaacttcaataaatgagcatataacaga

SEQ ID NO: 10506 - DNA, 1556 bp, Homo sapiens
agctacagtgcaggactacacctacctgccaacttttcccatgggccttcaattagtacattggaataggagttcggatgctggggcaagggaaagagagctaagaagggtcctgctgaggttttctcaaacaatgatgaaggccttattaacaaaaagttacccaaagaacttctgttaagaatgctgttcagcttgttgttaaattttacttggtctaatccagaatgtactaagtatgtacatagcattggtctggattctttttgtaatgtgaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactc

SEQ ID NO: 10507 - DNA, 1259 bp, Homo sapiens
gacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctg

SEQ ID NO: 10508 - DNA, 2777 bp, Homo sapiens
cgccgctcctcgcggcctccgcgtcttccttccgggtcgcgctaggccgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgt

SEQ ID NO: 10509 - DNA, 3115 bp, Homo sapiens
cgggcttgcggcggttgtgccgcatctagagagtcggggagccgcccccgcacccaggccttctcgcgctgcctggtcgctggtgaagcccgcggcgcgcgcctctcccggaccctgcaggatttttcttcctggcctggttcccttgccttctccatttgcttcattcgcttggattttcaagaagctttgaagctggataggagtctccagtcttcctcttgatccatatgtttcaggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacaggaggtggaggcaggaggattacttgagatgggattttgagactctagtgtacttatgattgcacctgtgagcagccactgcactccaacctgggcaatatagcaagtccctttctcttaaaaaaaattgtagtgtttccacttttcttctgatatttttgtctatttcactactggataatgccaatataaaaatttgggtataatcaagaataagaggtaaactactaaataaaaaaagctttccaactg

SEQ ID NO: 10510 - DNA, 3385 bp, Homo sapiens
accgggcgcgcgcgccgacggggcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtatatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcactttgcaaataatgcattttttacaaatggaaggtttatggcaactctgcgttgagccagtctattggtgccatgtttccaataaaacttctcctttca

SEQ ID NO: 10511 - DNA, 2949 bp, Homo sapiens
gtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagcctactactgttgactggaagccttaccaataacataaaacaatcgaataacaattatttcatgtattatatgtaaaatatatatactggattcttacagtaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagt

SEQ ID NO: 10512 - DNA, 2837 bp, Homo sapiens
atgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaa

SEQ ID NO: 10513 - DNA, 1440 bp, Homo sapiens
ggcaaaggcagctcgagcatctcatctgacgtgagttcaagtacagatcacacgcccactaaagcccagaagaatgtggctaccagcgaagactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctga

SEQ ID NO: 10514 - DNA, 4562 bp, Homo sapiens
tcactcgctccggggacccgcaacaagtggccgccgcgccctccccggggaagccgcgggcgcgcaggggcagccgaaggaggcggtcgagccgcggagcccaggggcctgcccggctcagcgcccaccggaggggatcggggcgggcggatggggacccggcggcggcggcgcggtgagcctctgggcggccccggggcgcgggctgtgcgcggcgctgcgcccgccggcccccagcgcggattgtaagtgctgcagctgtgcccggccccgcctggagccaccgggggtgccaggaggggacgcagcaccccctcccactggagtgcggggacctctccaggccggaggtcggccccggagcttgggggggatgtgcagctaacggtcccgtcgggcgggctttcctcgggccgagcgcgcaggacgtgcgccgcagctatggagtgtcccgggagacggcgggcatgacggctacaggatgggcgcgaacaatggcaaacagtacggcagtgagggcaaaggcagctcgagcatctcatctgacgtgagttcaagtacagatcacacgcccactaaagcccagaagaatgtggctaccagcgaagactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagcaaacaggcattttggtcaggtcatttgtaggcagtttctcttctcacaaaagatgtacttaagcaggctgatcgctgttccttgagcaaggcgcttactctcctccgctcaggcccccaaggccgccctttccctcgcacacaggccccacccccacagttccacgccccccccccaaggccacaccctccctccctagagcagcagcgaggatccatcatcagaatcacagtgctctccagacctcctctctaaactgcttcattgacctaagtcactctcttcaatcccacacccatggacattcttgtcaactcaataccatagcactttgcataggcaaaatacttttcaggcctttttaaaaaattcattacagcaaacagctggggaaggacatgcagtcctcccccagctctgtcaatgactatgaccttggccaaagcacttcactgctctgggctgcagcttccagcactgaatcagaggccacacagcccaaagattagcttcatgtccattatagcattgagggagcagagatacccatacacagaagcaccttggcatagagcacccaggcatcgacctcttccaggagaactgattctgtggatggatgtgatttcaggagattgtgcagtgccagcatcagtgcataaagggtcctgtatgtcctttggctgcaaatcacccacttccctgtgtttcagtgggagaatttcctctcccacctcctcacatcctcttttgccaggctggatgctgtcgtctctgtacacaaatactttctgcattcccccctccacaccatcctagcgaggcaccagcacacctaatcacagcaaagcccagatccccccatcagttgcttttactcagtgttttcaaataggagtaaaggcccttgcaatttttaattaacaagcaaggcccaagggaacacatgtcctcaaaagtttttctgatccctcgccttgcacacctggcatgcatcaggcacatctgtcctacagctggcagagacagatgcctcggttctttgtcattcagattgcatttgacctcttctcatctatttatttctttatacatccagacttcatcacatgaagcctattggggttaagtttgtaagtgtttaattgtgcaaattgccaccctgtgtacctcctccatgtctgtctgcgtgttttccaccaaagaatgcaaagcagacttccaggtgtttaaattctgttcactcaacaatgccagatgaatggaagagggaacacactgagatgacttagactctggtccaccaaccagacccttggaaaggaatactaaaatcattacaaggtatggattttaaatggatgaaacttcaaattatcttatttggatagaagtctatattctagcctcatttgcatgaagtcagatagccagaagaaattccattgctggttttcacgaaattcacttgtcttttgctaataaacacatggccctttcccagattattctctagccaagccccacctttgttacgttgaaatccctcatttattttcttctcaaaatgcccattatccaaatgcagaacctctgcatctccaagccagttatgctgaatttgtcaaacttagacacccttgacaactgcactcctactgtaggctcctgtgcatactgtcgtcttctgtgggggatggagaggttagtgtgatgaggtggtgtctgcccaggaggtttctttcaaacatcatggcctcccatccaatcaacatcatcaaattacatgtgtaatcaaggctctgtgccatgggggaaatgaatcatttagctaggccaggatctagtgaaagccacagagtttaaaaccatgaaagaagttgaaggcagcattcctcagctctgtgacttgtgaccctatttgaagtttcaggatttgggtgtcacaaaggattgtccctaatccttggccctggggtcttccgagtgagctggtttaatactctgagaatgagcagggagatccagagaatgaatccctgaccgcatcacctaaactgtcttccaaacatgagacaaagctgactgttcacactgattgcccagcacataccgtcttgccagtttcttcttttctcccagtctcctgttcatccattctgttctcccttggggtgggaatctatgatggaggttactggggaaacagctcagcagatttttggagaccaaaccaaaggtctcactaggaaatttatctgttttaaaacattgcttccttcctggctctgctaaattgaatgctcattgtttgttgttgttgttttttaattctaatgttcaaatcactgcgtgctgtatgaatctagaaagccttaatttactaccaagaaataaagcaatatgttcgt

SEQ ID NO: 10515 - DNA, 3221 bp, Homo sapiens
gagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaagatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgcagatgatgtggagaaagcacaaaaacaaggacaattggaaactcctggaaaactgcccagtcacccaaagaaaaagtcttggaaaatccctatgtcacctgaccaattcctcctgactgttagcgccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagccaagcgga

SEQ ID NO: 10516 - DNA, 3456 bp, Homo sapiens
gtttccaaggaggtctgtacaaaaagccagacttctgctggcagttactgagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagtatgctggggtgtatgaggggatttcccagacacctcccctcttggcccagttctggggtttctgggtccatctttttttttccaggaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaaggaggtgctcgacgtgtcccttctcttcctccgggtcatcagcgcctgtgcagatggcaagatccgaatttacaatttcctcaacgggaactgtatgaaggtgttaaaagccaatggcagaggtgatcctgtgctgtccttctttattcagggcaacaggatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagatgatgtggagaaagcacaaaaacaaggacaattggaaactcctggaaaactgcccagtcacccaaagaaaaagtcttggaaaatccctatgtcacctgaccaattcctcctgactgttagcgccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagccaagcgga

SEQ ID NO: 10517 - DNA, 3159 bp, Homo sapiens
atggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaaggaggtgctcgacgtgtcccttctcttcctccgggtcatcagcgcctgtgcagatggcaagatccgaatttacaatttcctcaacgggaactgtatgaaggtgttaaaagccaatggcagaggtgatcctgtgctgtccttctttattcagggcaacaggatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgcagatgatgtggagaaagcacaaaaacaaggacaattggaaactcctggaaaactgcccagtcacccaaagaaaaagtcttggaaaatccctatgtcacctgaccaattcctcctgactgttagcgccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaa

SEQ ID NO: 10518 - DNA, 3438 bp, Homo sapiens
acggtaaagccatgtttccaaggaggtctgtacaaaaagccagacttctgctggcagttactgagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaaggaggtgctcgacgtgtcccttctcttcctccgggtcatcagcgcctgtgcagatggcaagatccgaatttacaatttcctcaacgggaactgtatgaaggtgttaaaagccaatggcagaggtgatcctgtgctgtccttctttattcagggcaacaggatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgatgatgtggagaaagcacaaaaacaaggacaattggaaactcctggaaaactgcccagtcacccaaagaaaaagtcttggaaaatccctatgtcacctgaccaattcctcctgactgttagcgccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagccaagcgg

SEQ ID NO: 10519 - DNA, 4342 bp, Homo sapiens
ctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 10520 - DNA, 4539 bp, Homo sapiens
gtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggaggtgtagtccccgatctgcgtactgcgttcgccgagggggagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactctga

SEQ ID NO: 10521 - DNA, 2181 bp, Homo sapiens
gagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 10522 - DNA, 1843 bp, Homo sapiens
ggaagatgcttgactgctgtcttttctcagactagtctgaaagggaaaacccccattcattctggattggtggatctgaagtacaaaatattttccagaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggaga

SEQ ID NO: 10523 - DNA, 1647 bp, Homo sapiens
ttctttctcctccactgcaaagttaaatgcgagaaggtagaaacccagaggccatgctggcgctgagagatgagccccactcaccagattcaagatcccaagtgctgcagactttggcaaagcctataaattcagagcagcccggagaggagaaaggaaagtggatgtgggttcaggccgcatgaaatggagatccgattgcctgacttagctttgaagcgaatcttctctttcctggacctgttcggcttgctgcaggtttcccaggtgaacaagcattggaataggattgcagacagtgattacctgtggaggtcactatctctgcagagatgggactgcagcaacttcaccaatcaacacctgggcacacacacatggaagcaatttttcctgcatcaaagaaggaaggagcttcggttggcattggcacagccgcataactttatctacaaagtaactaagaacatcgcatttgagacggagttggcttatctctcaggaaatagacttacagtggatgaacaggagaaatcaatcatttgtagtgtatctccaaagcaagagctttgtgcctgggatgtgcaagagggtaccatgatctggtcaagcccagtccaggagttccatttctcaaatctggtaaccctccctcagatgcatctcgccatcactatggatcggaaaaaaactatcaaagtgtggaactgtcaggacagggacgctctggctgttctccccatgccacagccctgttattgcatggaagcctatcttacaaaggatggcccattcctgatggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgcatcatcttctgcaatgtagtaaagaaattctatttgcaa

SEQ ID NO: 10524 - DNA, 1211 bp, Homo sapiens
ttctttctcctccactgcaaagttaaatgcgagaaggtagaaacccagaggccatgctggcgctgagagatgagccccactcaccagattcaagatcccaagcatttgagacggagttggcttatctctcaggaaatagacttacagtggatgaacaggagaaatcaatcatttgtagtgtatctccaaagcaagagctttgtgcctgggatgtgcaagagatgcatctcgccatcactatggatcggaaaaaaactatcaaagtgtggaactgtcaggacagggacgctctggctgttctccccatgccacagccctgttattgcatggaagcctatcttacaaaggatggcccattcctgatggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgcatcatcttctgcaatgtagtaaagaaattctatttgcaa

SEQ ID NO: 10525 - DNA, 1370 bp, Homo sapiens
ctggcgctgagagatgagccccactcaccagattcaagatcccaagatgggcatgggtgaaaatctttacaagtgctgcagactttggcaaagcctataaattcagagcagcccggagaggagaaaggaaagtggatgtgggttcaggccgcatgaaatggagatccgattgcctgacttagctttgaagcgaatcttctctttcctggacctgttcggcttgctgcaggtttcccaggtgaacaagcattggaataggattgcagacagtgattacctgtggaggtcactatctctgcagagatgggactgcagcaacttcaccaatcaacacctgggcacacacacatggaagcaatttttcctgcatcaaagaaggaaggagcttcggttggcattggcacagccgcataactttatctacaaagtaactaagaacatcgcatttgagacggagttggcttatctctcaggaaatagacttacagtggatgaacaggagaaatcaatcatttgtagtgtatctccaaagcaagagctttgtgcctgggatgtgcaagaggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgca

SEQ ID NO: 10526 - DNA, 1379 bp, Homo sapiens
ctggcgctgagagatgagccccactcaccagattcaagatcccaagcattggaataggattgcagacagtgattacctgtggaggtcactatctctgcagagatgggactgcagcaacttcaccaatcaacacctgggcacacacacatggaagcaatttttcctgcatcaaagaaggaaggagcttcggttggcattggcacagccgcataactttatctacaaagtaactaagaacatcgcatttgagacggagttggcttatctctcaggaaatagacttacagtggatgaacaggagaaatcaatcatttgtagtgtatctccaaagcaagagctttgtgcctgggatgtgcaagagggtaccatgatctggtcaagcccagtccaggagttccatttctcaaatctggtaaccctccctcagatgcatctcgccatcactatggatcggaaaaaaactatcaaagtgtggaactgtcaggacagggacgctctggctgttctccccatgccacagccctgttattgcatggaagcctatcttacaaaggatggcccattcctgatggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgca

SEQ ID NO: 10527 - DNA, 2483 bp, Homo sapiens
aagtggctccaaggctgcaggtgtgaggggcgtgcccagggctcggcccgcgccgccccatgtgacccggtccgacatggtgtcgcctcctcccggggcggcggcggtggcggctcgggctgggctccgcgtcgggccggccccgcggccgctcatgggcagccagggccgctcggggccccccgggaacggcgggcccggcgagggcgagggcggagaggcgaggaagctgcaggaagggagggtggcgagggggaagcgaaggaaggggaaggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggacaggggtggccatggcggcggcggccggggaggaggaggaggaggaggaggcggctcgggagtcggctgcccgcccggccgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcaggcaaatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 10528 - DNA, 2209 bp, Homo sapiens
ggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggacaggggtggccatggcggcggcggccggggaggaggaggaggaggaggaggcggctcgggagtcggctgcccgcccggccgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcac

SEQ ID NO: 10529 - DNA, 756 bp, Homo sapiens
gggcgccaggccgggaagagcacagggacgagggggtcaggcttgggccgacatcgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcaggcaaatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcag

SEQ ID NO: 10530 - DNA, 688 bp, Homo sapiens
ctcacgtgtttgcagcgcgaactcctgtgcttccaccaagcgctctcggggatgcgggggtggtgtcagcgccccggccccagcccgcaccccgaagtggctccaaggctgcaggatgaccagtgtcccagtgaaggaacgagtgaaggtgtctcagaactggagactggggcgctgccgagaggggattctgctgaagtggagatgcaggcaaatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaac

SEQ ID NO: 10531 - DNA, 3734 bp, Homo sapiens
cttacgggttccctggagcggatcaccatataattgatgtgcagtctgcattgctgaatcctggactgcaccattctgtgttcaagggaagatgtaatctgatccctctgctgctgagggaggaatctgttcagtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtt

SEQ ID NO: 10532 - DNA, 3896 bp, Homo sapiens
ccttccgcagctgccgcttcagtccgaaggaggaagggaaccaacccactttctcggcgccgcggctcttttctaaaagtaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtta

SEQ ID NO: 10533 - DNA, 3570 bp, Homo sapiens
agacaggtcaggacatttggtaggggaaggttgaaagacaaaagcagcaggccttgggttctcagccttttaaaaactattattaaatatatatttttaaaatttagtggttagagcttttagtaatgtgcctgtattacatgtagagagtattcgtcaaccaagaggagttttaaaatgtcaaaaccgggaaaacctactctaaaccatggcttggttcctgttgatcttaaaagtgcaaaagagcctctaccacatcaaactgtgatgaagatatttagcattagcatcattgcccaaggcctccctttttgtcgaagacggatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtta

SEQ ID NO: 10534 - DNA, 1735 bp, Homo sapiens
attttgcttttcccttctagtcatgataaagtatttcttggatgagaaatttgcatttaatgttaaactaactgttaatgctattttttaaatgtatcagtcttctattaatatggctgataccaggacaaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgc

SEQ ID NO: 10535 - DNA, 2343 bp, Homo sapiens
gcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggaggtgggctccgggcgcggcgaacaggcctcgggggacccggcgctggcccagcgtctcctggagggcgcggggaggcccccggcggcgcgggcgactcgggccgaggggcaggacgtagcgagccgctcacgttctcctctggcccgcgagggcgccgggggcggggagcagctggtggaccagctcatccgcgacctgaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacgaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctatgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgt

SEQ ID NO: 10536 - DNA, 4648 bp, Homo sapiens
acttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacgaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctatgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccagaaggttttgttttttttcaggtggggtctcgctctgtcacctagactagactggagtgcaatggcctgatctcggctcactgcaacctctgcctcccgagttcaagcaattctcctgcctcagcctcctgagtagctgggattacaggcgtccgctaccacaactggctaatttttacatttttagtagagacgggggatattgctatgttggccaggctggtctcaaacttctgacctcaaatgattgcctgcctcagcctcccaaagtgctgggattacaggtgtaagtcactgtacccagcccaaaagcagtttaaaaaaaaaaaagacaaaatatacaactcttgataaaacataaaggtacagtggtctatgaggaagagaaaaggtacctgaggatgcagaagtacctaccacatgggaaccgtttgtccacactcattccagagaaaaccgagtcctctcagttgcacacgtgtacgtatcagtgggaagtgcttgccattactccaaagcctagaaccttcacgtcatgaaggttctggaaggtttttcagattgcttaagatacgcagccattccatattcatctccaactacacaggggaacggagcagatagagctgcgactgggaagcgtcaccttcccgtccagagcgctttctttcagaccctgcctacctgcaggcagatggaccggagggttttctgcttcctttcaaccagataacttcctaagtggagatggcctgtaggtagcaaatgcaggattttgtttactttcatcatgtcatgtggtggtcagactgctcgctggtggcctcgctttagaaggttttcatcaagccccgccctttctctctcatagtcttaatgcgtctggaccactggggaaaatatttttcttttcaaaaagcagccccttcagtctgcgttcccagttcattttgcaggcgcattcgcccttcctagtttgcagcaattaaagataacggagtgtaaagtcattagacccagaattagagcagccagcagctggcccagtgtaaaaatgtcccaagtgtagcccctcccaccgcagagcctgtttctaacgtacctgccattcgtggaagtcgcctgggttttgtaaaggagaattttttggactcaagctgtcatcttcaagcacgccaacttcaggcagtgttttctactgcaaacctccacatcctggaatcaatcacactgacagggaaaggataaatgctcctttataagccaacatgtatccaaattaagcccccttacctttatccagaccctttcacaaacaagttctgagtttttagccaattgatcctctactttccttctttagtccctctcagggacgcctccatccccggctcccctaaaggtagaagatactcgagcatgctgccaggggagctggatggtgaaacacctgaagatctcatatcgcctctcaaaacactgtcggacttgctttctgctttatgatgtccgtagttgttctaatattaaatgctttgaatttc

SEQ ID NO: 10537 - DNA, 2243 bp, Homo sapiens
acttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacgaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctatgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccaggtcaaacaccagaatgaacgggctcactgggcacttccgtacagcgtcatttactattgtgcatttgtatggttatgggaggcaatttttattttacaataattttttattcattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgc

SEQ ID NO: 10538 - DNA, 4575 bp, Homo sapiens
gcggccgcggcccggactccgcggtgggcgagcgccctgtgaggtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagagcaaggtgaaatcatcttgaaggtgcctgtggagattgtagggcaggggaagttgggtgaagtggccctgctggccagcattgatcagcactgctcaaccacacgcctgtgcaacctcgtcttcacgccagcctggttctcacccatcatgtataagacaacatcaggtcacgtccagtttgacaactgcaactttgagaacgggcacatccaggtccatggcccgggtacttgccaagtgaagttctgtaccttcaaaaacacccatatcttcctgcacaacgtgcccctgtgtgtcctggaaaactgtgaatttgtgggcagtgaaaacaactctgtgactgttgagggtcacccatctgcagataagaactgggcctacaagtatctactagggcttatcaagtcctcacccacttttctccccacagaggactctgactttttaatgtccctggacctagagagccgggaccaggcctggagcccaaagacctgtgacattgttatcgagggcagccagagccctaccagcccagcctctagctccccaaagccaggctccaaggctggctcacaggaggcagaggtgggtagtgatggtgaaagggtggcccagaccccggacagcagcgatggaggcctgagtcccagcggtgaggatgaagatgaggaccagctgatgtacagactatcctaccaagtgcagggcccacgccctgtattggggggctcatttctgggcccacctctaccaggagcatccattcagctgcccagctgcctagtgctgaactcactgcagcaggagctgcagaaggataaggaggccatggcactggccaactccgtgcagggctgcctcatccgcaagtgcctcttccgggacgggaagggaggcgtcttcgtctgctcccacggcagagccaagatggaaggaaacatcttccggaacctgacttacgcagtgcggtgtatacataatagcaagatcatcatgctcaggaacgacatttaccgctgccgagcgtcaggcatctttcttcgcttggagggcggtggcttgattgccggcaacaacatttaccacaatgcagaggctggtgtagacatccggaaaaagtccaacccactcatactgtgtaaccagatccaccatggccttcgctctggcattgtcgtccttggcaatgggaaaggcatcatccggaacaatcaaatcttttccaataaggaggctggcatttacatcctgtaccacggaaaccccgttgtgagcgggaaccacatcttcaagggccgtgctgccggcatagcagtgaatgagaacggcaaaggcctcatcacagaaaatgtcatccgtgagaatcagtggggaggtgtggacatccgccgtggagggatccccgttctcaggagtaacctcatctgctttggctattcagatggtgtggttgtgggagacgaaggcaaaggcctcatagaaggaaataccatctacgctaacaagggctgtggtgtgtggatgatgtcgtccagcctcccccatgtcaccagcaaccacgtcagctacaatggcctgtatggagtggcagtatttagccagaaggatggctccagcgagttacctcgaggccacagggctcaagagaacttcagcgaggatggggacgccatcctctgggagacagagctggagaaggaggacgacccactgcgccggcccatcaccatagctcttgttgagtctaacagtattaatcacaatggagcctcaggactctatgtccagagcagcgaggcactgcatgtcatcaccaatgtgatccacgcgaatggggacagaggcattactgtggcccagagcagccaacccacccgagtggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcaggattttctctgagttctaaggaactgtgttttacacacaccaaacccagactcttctcaggaaagagcagatttacttctgatggcgggaagtgattctagtgaggtggagagagacaactgctccagaattttcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatgcacaaggctctactccatccccagagagctcccaaatgcagaaggattcaaaccccatgtgagcgtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggaaggccagctcccagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcacttggctgcgtggctggttctattggccctaggtgctgctctgttgggtgggatgggagggggtagagggagccaggagcactgggttctccctgagaacactgggcacaagagtactggcctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatattttaaaaaaggca

SEQ ID NO: 10539 - DNA, 498 bp, Homo sapiens
ggcagctgtccgcccccgggcggggctggccgcacgccgcaatcctaccggctgctgcggctccagcgggggcggcgggtggcttccagggcaccggcggccgcggcccggactccgcggtgggcgagcgccctgtgaggactacagtgaagaacagaggggaaagtcatttgaggagccagaactctggagtcagttagctctggttcagatcacagttctgccacttactggctttgtgaccttcagccagattgattcctcatctgtgaaaaggaggtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttgg

SEQ ID NO: 10540 - DNA, 1514 bp, Homo sapiens
cacgatatgaagagcctggttacagtttcgactcctctctgcaagtgaataggcccagaaagatcatcatgctcaggaacgacatttaccgctgccgagcgtcaggcatctttcttcgcttggagggcggtggcttgattgccggcaacaacatttaccacaatgcagaggctggtgtagacatccggaaaaagtccaacccactcatactgtgtaaccagatccaccatggccttcgctctggcattgtcgtccttggcaatgggaaaggcatcatccggaacaatcaaatcttttccaataaggaggctggcatttacatcctgtaccacggaaaccccgttgtgagcgggaaccacatcttcaagggccgtgctgccggcatagcagtgaatgagaacggcaaaggcctcatcacagaaaatgtcatccgtgagaatcagtggggaggtgtggacatccgccgtggagggatccccgttctcaggagtaacctcatctgctttggctattcagatggtgtggttgtgggagacgaaggcaaaggcctcatagaaggaaataccatctacgctaacaagggctgtggtgtgtggatgatgtcgtccagcctcccccatgtcaccagcaaccacgtcagctacaatggcctgtatggagtggcagtatttagccagaaggatggctccagcgagttacctcgaggccacagggctcaagagaacttcagcgaggatggggacgccatcctctgggagacagagctggagaaggaggacgacccactgcgccggcccatcaccatagctcttgttgagtctaacagtattaatcacaatggagcctcaggactctatgtccagagcagcgaggcactgcatgtcatcaccaatgtgatccacgcgaatggggacagaggcattactgtggcccagagcagccaacccacccgagtggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtga

SEQ ID NO: 10541 - DNA, 3933 bp, Homo sapiens
cggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggaaacgattatatatggaagtatttgaatatactcgccctatgatgcatcctgaacctggaaaattctaccagattaatccagaagagtatgaacatccaaatccctggaaagagagtttccagcagttgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatc

SEQ ID NO: 10542 - DNA, 591 bp, Homo sapiens
cggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggctaggcgaagtggctcacgcctataatcccagcactttgggaggctga

SEQ ID NO: 10543 - DNA, 3844 bp, Homo sapiens
atcatagcaataagatttgtaaaacattgcaatggctgaaaaactgtctaacaggaaattttaagtgttattccaaagaagaacaagcctaaaaatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggaaacgattatatatggaagtatttgaatatactcgccctatgatgcatcctgaacctggaaaattctaccagattaatccagaagagtatgaacatccaaatccctggaaagagagtttccagcagttgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataa

SEQ ID NO: 10544 - DNA, 4055 bp, Homo sapiens
ctcctgccccgaagctcgctgtgcgtgtgcgtgtgtgtgtccctccgccaacgccgccacctcagcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggaaacgattatatatggaagtatttgaatatactcgccctatgatgcatcctgaacctggaaaattctaccagattaatccagaagagtatgaacatccaaatccctggaaagagagtttccagcagttgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataa

SEQ ID NO: 10545 - DNA, 2028 bp, Homo sapiens
gttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatctt

SEQ ID NO: 10546 - DNA, 1816 bp, Homo sapiens
cttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccagggcctttgggtgcaggtgactgtagggcctgcgggtggggtcccctggcgggaagcccgtcactgcgcggccccgctctcttcaccgtgtattttattcgtccagcttggcgcaaggcccgtggccgtcttcaacgtgagaaggaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcagagtgctgtgcaatgcc

SEQ ID NO: 10547 - DNA, 1721 bp, Homo sapiens
ggcgacgtgcgggcgtgggggcggtgcgtgcactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccagggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcagagtgctgtgcaatgcc

SEQ ID NO: 10548 - DNA, 1343 bp, Homo sapiens
tttatagacggtgattgggctgctggaagctgggaggggtgagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatgatgtcgaggagaaatcccttcccactatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggca

SEQ ID NO: 10549 - DNA, 1560 bp, Homo sapiens
gtgcctcccctagccgcctcctcccagcagtcccccaggagcgagctgcgagatgccccaaatcggacccctccccagttggaaaaaaaacgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccactctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaaggaaggaatgaatgaaaaaatgga

SEQ ID NO: 10550 - DNA, 682 bp, Homo sapiens
acagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgctccagttctcccaggtggtgtcgcaaagcacagagggctactgggaggagctgctggacacgactcagccggccatcgtggtgaaggactggtgaga

SEQ ID NO: 10551 - DNA, 4138 bp, Homo sapiens
aggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttccgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaacc

SEQ ID NO: 10552 - DNA, 2906 bp, Homo sapiens
atggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaagtctttctgtcttgttttgaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaa

SEQ ID NO: 10553 - DNA, 4687 bp, Homo sapiens
cagtaggcggggccaggcggggcgcccgggcactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttccgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaatggcctgcccaatttcgtttgaggacagaaagcccagccatgacttgagtagaatgtctctcacctctcttcggatctaaatatgaaaagtatgttctgctgaatttttctgagcattggtgagcggacagcctacctgtaaaccatgacctccttgccaaacgttaattttatcagctcactagtaacctttgagaattatctggttgtcatgcaaagattgcactttctgaattatgttaaaacacatgttgtaaaatgagaactgctcatgctttgaaagaaaaccaggttcttcgtgcgttctgttgccgttgatttgaatggctgtgctgtatacgatgtgtccagaatgtcttcagagcactgtttccgtgtgatgttactacctactatgtgggaggaaaaaaggttataggttaaacaaagtcaa

SEQ ID NO: 10554 - DNA, 2656 bp, Homo sapiens
caggtacgcggacaagatggcggcggcagcagtcgacagcgcgatggaggtggtgccggcgctggcggaggaggccgcgccggaggtagcgggcctcagctgcctcgtcaacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaaggg

SEQ ID NO: 10555 - DNA, 3483 bp, Homo sapiens
gtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtcctttaatttatggttattctaaatcctagttcctgaggcaagtccaaagaaaaatttgtcaaaacttttcatctatgaatatttatatttagctcttgctatttagctattatcaaaatacctcaaaattttagtccttgaatgtgctcatatagcccataaggcaaatattttttaaactttattgtccctgatattaaccagaattggttgaatagtagaggaaaagggatttttaaaactgaaaatatgaacaaaatgagccttagaattgaatggattattttaaacaaattaatactcatataaaatgttttgctgcttctcaaagagtctgatacagggtaatttcatacaatatttgatgttgttaaagcattcctttttatagctgagcctttggagcttgttatgaacagtaaaatcatttagtcacatggttgtaaccttagtgcaaagtaaaaagggaaaagttgacctaatagaaacaatagtagtattgataagaacaaaagtcatcctccctgcctctcagaggccctgaagtcctgtgaggaagggaaatagtaatttaaccaaagttaaatctgtgtaactcatttattacaattttgaaaggcttgtcttagaagcattaaaggagtattagctaaaaacaaa

SEQ ID NO: 10556 - DNA, 1822 bp, Homo sapiens
gtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtatgtcttgtgtgcttctgatttcgtctgtgaatgaagggaaatggtctcaggttttgtcactttggggttaacaatttaaaaaacgtgtttaaagaattattaagataatagttcattccattttgtagtagacattggctaaggggcttactgaacataattctgcttacggttgaataattacatttttatatatattgtccttcaagaacttccttgagtcacattctccttaaaatttgacattgcctgttgatctttcctttgacagatgtggtactctgtgtgacctcaatgtgtcacctcctttctagtttcctcctttaaaggaaacacatggttagagtgtatctttatggcaaaacttctcagagcttctaatatgcccagtgctgtggaaatctggaaggagaatagcattacctgtgacagttcccaaatgtgtttggtcacaaaacttttttccacagaatgtcttgcaagtcgtactggtttttggaaattctgtattagatcttttgaaaggctttttcaagcttaaaaattgtggatcttttttgttactaaggcttttgctttcaaagataaaaatatttgctcttctgtcttgggagccattacttcctttccatcttgaatgaaaatacatatcattttgagtttgaaacaattaggtggacataaatatcatttgtttccagcaggaaaatcagaccctaccccaccctcaatgcttgtaaacactactatttgtttcccactctgtttaatatttgcatcctagagtggtgacatggggacagactgttgcagatcagtatctataagaataatgtaagtcatcctagttatagtctctcttctggttatctctatgagctagatctgggaaaatagctaaagttgaggtccctggactg

SEQ ID NO: 10557 - DNA, 1402 bp, Homo sapiens
aggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcata

SEQ ID NO: 10558 - DNA, 2276 bp, Homo sapiens
gagagaagggaggggaacaaggatagagcgctcgccaacggccgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctg

SEQ ID NO: 10559 - DNA, 2088 bp, Homo sapiens
gctcgccaacggccgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcaggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcg

SEQ ID NO: 10560 - DNA, 2087 bp, Homo sapiens
taggctggggacatggtgtgggaaagccagcaggaacgggggggccaagggcctaggagacaggagggcaggagcagggagggggcaatcaggatggtcaggggaagccagagacggaagctgcaaaaattcaccaggctgtgtggacgggaggaggggctccgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgag

SEQ ID NO: 10561 - DNA, 957 bp, Homo sapiens
atgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcaggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagatcctattctgtgctcttggctacaaccaccttggcctggtggatga

SEQ ID NO: 10562 - DNA, 1901 bp, Homo sapiens
agactccatgggggaggggcctaggaggcagaggggcctcagaggtcccccaagcctaggctggggacatggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagg

SEQ ID NO: 10563 - DNA, 2292 bp, Homo sapiens
ggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactaccatcttgctttactattcaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttat

SEQ ID NO: 10564 - DNA, 2229 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaat

SEQ ID NO: 10565 - DNA, 2360 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgtt

SEQ ID NO: 10566 - DNA, 1286 bp, Homo sapiens
ggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 10567 - DNA, 1019 bp, Homo sapiens
gggccgcgggcgcgtcaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaag

SEQ ID NO: 10568 - DNA, 632 bp, Homo sapiens
gtgtgagcgcgcagtgatgccctagagtgcagtcatcccgggcttggcgcccagcgggtggaaatacggccgcagggtggaaatgcggcggcggggctgcccaggctcctgtgggacccgcgcggcgcgggcacgcacattctcagggacgcgcgtcctcaggccacgagaacacctgaaggccccggccagcgtcctcccgtgaagacccggaccggcgtcgtcacccgccgcgcaggcctaaatctcaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgt

SEQ ID NO: 10569 - DNA, 2320 bp, Homo sapiens
ggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgagaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctgttgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtggctcatgcctgtaatcccagcactttgggaggctgaggcaggcggatcacctgaggtcaggagttcaagaccagcctggccaacatggtgaaaccccgtctctactaaaaatccaaaaaattagccgggcttggtggtgtgcacctgtaattccagctactcgggaggctgaggcaggagaattgcttgagcccgggaggcagaggctgcagtgaaccaagatcatgccactgcactccagcctgggcaacacagcgagactccgtctcaaaaagaaaaagtttggatcaggcagggtggctcacacctgtaatccctgcactttgggaggccaaggtgggaggatcagttgagccccagagttcaagaccagcctgggcaatgtagtaagacccccatcgctacaaaaaatacaaaagttagccaggtacagtagtacacacctgtagtccaagctacttgggaggctgaagtgggaggatcatttgtgcccaggttgaggctatagtgagccatgatcataccactgcactccagcctgggtgacagagcgagaccctgtctcaaaaaaaaaaaagaatttggagatggttctgcccactctggtttctctgaaaaaacgaggtaattccctgagcccaaccctgatcctcaaggacctgtaattgtgtggtatttaaaattaaaataacattatttttattttgactttttttcaaacagtaagaataatatatcagcagcatgtatctgccaatcatatgtaataaatttcttattttgcc

SEQ ID NO: 10570 - DNA, 2130 bp, Homo sapiens
gaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgagaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctgttgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtggctcatgcctgtaatcccagcactttgggaggctgaggcaggcggatcacctgaggtcaggagttcaagaccagcctggccaacatggtgaaaccccgtctctactaaaaatccaaaaaattagccgggcttggtggtgtgcacctgtaattccagctactcgggaggctgaggcaggagaattgcttgagcccgggaggcagaggctgcagtgaaccaagatcatgccactgcactccagcctgggcaacacagcgagactccgtctcaaaaagaaaaagtttggatcaggcagggtggctcacacctgtaatccctgcactttgggaggccaaggtgggaggatcagttgagccccagagttcaagaccagcctgggcaatgtagtaagacccccatcgctacaaaaaaaaaaaaaaagaatttggagatggttctgcccactctggtttctctgaaaaaacgaggtaattccctgagcccaaccctgatcctcaaggacctgtaattgtgtggtatttaaaattaaaataacattatttttattttgactttttttcaaacagtaagaataatatatcagcagcatgtatctgccaatcatatgtaataaatttcttattttgcc

SEQ ID NO: 10571 - DNA, 5451 bp, Homo sapiens
ccctgttccccttgctgtgggggtaaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttggtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaaggtcatccataaaagtccccgtctggaactcgttttctcagcacttctcatttttataatcatagtatttagccatattagcatatctttagaggaggcctggtggaatacccggggcctctactagtctgcttttccggtcataggaagacttttttttttacgtatcaaagcatgtgtttacagatttacagagtgtgatccgtatgcatcaaagggatacagccccagactgtttctttaatggtcattcatgaactattaaaaatttcctgaatttctttttaaactacatctagatagcctaaacatctatgtagtcttccattagttaacatgtgtatagggctttcataataagtagtcacactgttacaaggtaaattttctattacaaaatccaaatttctattgcatacacttataatcatctattcataaagctaattcattgtacttgttaatgcatgaatgttccatgcagtaggagaataaagcactacagttcggttgttcaaatcttaaatcttaggctatttagctaaaacatgttaggatattgccttcaccacttgttaggacagttatttgatagccattatgcttacctatggatagcataatggtatttaaggttcaacaaaccgcagattattatgatcagctagaactgacatatgttacaagaaaactgtaaattaacctcctgagagaaccattctgccctgcattttaagtcaggtatttaaatactgcgtgttgttaatattgcgttgtcttagtgcaacatttcttaaagtattcccgttatcttccttggctgtttttcagaggagacgtctccatgttaatgggtccttcccacatagaaatgtattctggtacagcgctgcacacatggatagcaatgtgaaaaggcatgcctaagagacagaaacggctgaccttaccccaccccagccggatcctctgcttatctcccacatgcacttggcttaactggttttcacagattctgaggttatagaacctgttgtttttcaaactcctgtacagagcctggaaataatggagcaaacgcaaatgtattgagagtcattatactttaaaatagttttaaagactattggggtaccatcaggtcaaaagccactgatttgggaagcaatttttttgcaaaacactttttttggagtactgaactttacaggggcttgccttaatctctatttagtagtttcaagatatatgcgcaattattctacgtgttaaaaatgttaaaatattctatgtagccccaaaggtgggtaaaacagtataagtaatgcctaaattaataagctaaaaggtgtcactacagctggatttttgagagaaaatggacataaaactaggctatgtgtaataaaaataatggcaccttaagattgcactattttatgcattattttatatgccatttcatagcctgcactttaatctccaaagaaacgatgtatgatgtcccacttgttccttattcttaataaactttttcctgagacagggcacttaattctattttactatactgaattagtttcttggaggtagattcatttcttgagttctctgtttccttagccataatattttctaggatccgggaactccctatattgtctatttccaacattatataattttaatttaatgtaatgtaaatctcatacttggtgatcagcacattcttatatcctgctctagcaatgagtacccatttgttacacttaccaaactctctaaaaacatatactgtgagtaagatttgaagccaggaataaaaggcagtctgaaagaaaacgtcctatacgatgcagttgtttggaaatggctgatttctgatatgaaacccaacttgatacactgtttggttctttgacttgggatctatctgaattgctttcactagtacacaaaaggttaagttaaaactactttaaacttgtatagcctgccatctgaggtgaattattttcaaaaaatactaaatctatgaactgagactagcaattagttggctgctccctaccatgattttacttttaatagcaatacagttatattggtgataaatatgacaggcttaagtactgctgtccttttgcatcttcctaagcatcttggttaaatttctgaagtttaaaaattagatccagatttcttctgttgtgtctgaagagaaccatgacatttagaagtatattggtaatctattaggtccattggcaaagtatattggtccatattcaaacctattccaaaaggttagaagtgtttaagattcctttattgtggtaccatgtctgtttacctatgcttatgagcaacaataaattactagtttaccttctggaattttaattgttataaccgaatcaattattggaaagtgaaaaacacctcccggtcacacaacagggtacgtaaataaatgtgttgttaccagtg

SEQ ID NO: 10572 - DNA, 1334 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctacttttt

SEQ ID NO: 10573 - DNA, 2397 bp, Homo sapiens
ctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttcc

SEQ ID NO: 10574 - DNA, 2394 bp, Homo sapiens
ccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggccgggatgatctcaagaaatatttggagcccaggtgtcctcggatggtttgttagtataaatagagggtgctcgagaggaagacctcgatgctgtggaagcgcagattggtgcaagcttcctgacgattatcgatgttcataccgaattcacaatggacagaagttagtggttcctggaagttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttcc

SEQ ID NO: 10575 - DNA, 1672 bp, Homo sapiens
aggggcggggccagggcggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggtaagttaaattttcctctagtgctgatttacatgactttgtagggttaacactgcagataagccaggcaaatagttagtttataaatagtgttccagagaaccctagagattttgagaaagtatcttgggggtcatgtgaatttgttgagagaaatggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaagaaaa

SEQ ID NO: 10576 - DNA, 4376 bp, Homo sapiens
gaaaaggcggcggcccggctggggaagaggggcggaggaggcggttcggacggctgtgtggggtacggagcgtcgccgggacagagcggagcagctgggcacggcgtccagggcagctagggcctgggccgcggttcggccgcgccggccgagctggactggccattatggaggaggagctgcagcattcccattgtgtgaattgtgtcagtagacggtgcatgaccaggccagagccagggatttcctgtgatttgattggttgtccattggtttgtggtgcagttttccattcttgtaaagctgatgagcatcgacttttatgtccatttgaacgagtgccttgcttaaatagtgactttggatgtccatttaccatggcccgaaataaagttgctgaacatctagaaatgtgtcctgcaagtgtggtgtgctgtactatggaatggaatcgatggccagttagttatgcagaccggaaatcatatgaaaatctaagcagagatgtcgatgaagtggcacaattggatatggccttggctcttcaagaccaaaggatgctcttagaatccctcaaagtagccaccatgatgtcaaaagcaactgataaagtatccaaacctagagaacaaatctcagttaaatcaagtgtcccagaaataccacatgctaatggtttagtgtctgttgatgaagaatcttatggtgcactttatcaagctactgtagaaacaaccagaagtttggctgctgctttggatatcctgaatactgctacaagagacattggcatgttaaatacaagtgtcccaaatgacatggatgaacagcaaaatgcgagagaaagcttagaggatcaaaacttgaaagaccaagatcatctttatgaggaggaaataggagcagtaggtggaattgactacaatgacacaaatcagaatgcccagtctgaacaaaatggttcaagtgatttattatgtgacttgaatacaagttcttatgacacttctgctctttgtaatggctttcctttggaaaatatatgtacccaggtcatagaccagaatcagaatttacatggtgattcaaaacaaagtaacttaacaaatggagactgtgtggcatcatcagatggcacttcaaaaccttccagctcacttgcggtggcagcacaacttagggaaataataccatccagtgctttgcctaatggcacagttcagcatatcctcatgccagatgatgaaggtgaaggtgaattgtgttggaaaaaagtagacttaggggacgtgaagaatgtggatgtcttatctttcagtcatgctccttcattcaattttctttctaattcatgttggtctaaaccaaaggaagataaagcagtagatacatcagatttggaagttgcagaagatcctatgggcctccaaggaatagatctgatcacagcagcattgcttttttgtctaggagattctccaggagggaggggtatatctgatagccgcatggctgatatttatcacattgacgttgggactcagactttttcacttccatctgcaatattagctacaagtacaatggttggggagatagcttcagcttcagcttgtgatcatgccaatccacagctttcaaatccaagtccgtttcagacacttgggctggatttagtattggaatgtgtcgctaggtaccaacccaagcagcgttcaatgtttacctttgtgtgtggacagttatttagaaggaaagaattttcttcccactttaagaatgtgcatggtgacattcatgctggactcaatggctggatggaacagaggtgccctttagcttactatggttgtacctattctcagcgtagattttgtccatcaatacaaggagcaaagattatacatgaccgccatttgaggtcatttggagttcagccatgtgtatctacagtattagtggagcctgctagaaactgtgtgttgggattacataatgaccatctaagtagtcttccttttgaggtcctgcagcatattgcaggctttctcgatggcttcagcttatgtcagctctcatgtgtatccaagttaatgagggatgtgtgtggcagcctgcttcagtctcgtggcatggtcatactgcagtgggggaaaaggaagtatccagaaggaaattcatcatggcagataaaagaaaaggtatggcgatttagtactgcattttgttctgttaatgaatggaaatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgtgagattgaataaacagtctctatttctgtggaaaaaacaacagaaaagagatattaaataccataaaatgtaactctgccttttaaagttttgctgaagaatgtgtctgtggttaggatagcacaagcattaacttttgttttatagttatgctttttaaaattcattgtttttaaatttagacttcttatttccacactggattatgagatacttaacaatttttccaccttatatttcttttacacattttgctgttctcttttttgttattgttatgccaccataccattttgttaaaatgttttctttgtgaaacatttgttcaagttctaataaaattaatgttttcccttaacatggctcaataacttaaaaacgttcatttaaataaaattttaatacttgtttgacaaa

SEQ ID NO: 10577 - DNA, 3614 bp, Homo sapiens
tggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctc

SEQ ID NO: 10578 - DNA, 6744 bp, Homo sapiens
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggattgcttgagcccaggagtctgaggtttgcagtgagctatgattgtgccactgcactccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctgagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggaatagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgagctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 10579 - DNA, 1227 bp, Homo sapiens
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaac

SEQ ID NO: 10580 - DNA, 3853 bp, Homo sapiens
tcttccggaagtcgcgccggtgcgcgccggactcctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggccacgcccgcagaggcctttccccctctccacaacttgtgttctacttggttccgccgagacccacgacggttccgcccccttcttcctagtcattgatgttgttgttcttgtcagtgccgcagccccgaccgccgggagctcgaacccgagccggggccgcccgggtggcgcggtggcggcggctgcggctgcagcagctgcgacggctgcgggggctgctccgggtactgcgggggcggccgggagccggcagccggcggcggggccggatggctctgtgcgggcaggcggcgggcgctgcgtcgctgcccagcgagctgatcgtgcacatcttctcttttctgccggcgcccgaccggctgcgggcctcggcctcctgctcgcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggaaccttcagaagtttagtctttttggagacataagtgttctacaacagcaaggaagtttgtcaaatacatacctcagcaaggtggaccctgatggcaaaaaaattaaacaaattcagcaactgtttgaagaaatcctgagtaatagtaggcaactgaaatggctgtcctgtgggtttatgctggaaatagtaaccccaacatcactgtcatctctctctaatgctgttgccaacaccatggagcacctcagtttactggacaataatattcctggtaacagcactcttattactgcagttgaactggagcgatttgtgaatctgcactcacttgccttggatttttgtgactttacagctgagatggcaagagtcttaactgatagcaaccatgtgcctttgcaacgactgtctcttctggttcacaatgtttctgtaatgcacaagtctctggacaacatgccaaatgatgagcattggaaagccctgtcacgaaagagcaccagctttcgggtctatataatggcttttgatatcaagagtgaagatatgttaaagattctgaaacccagtataccactagagaggattcattttgatagctatatcacttgtgtttcaggggctattgttgatcttatatccaggcaatatgacaagttcctcactcattttattttaatgaatgatgtgattgacacatctggttttccagatcttagtgacaaccgaaatgaagatccgttggttttattagcatggaggtgcacaaagctctctcttctggcaattcatggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaagaaaaaaaaaacatgcacctgtttcactgtgaatagtgaatgtaaaggaaagaaaggaaaaactgaaagcttgttctatcacaggtatgagctgctatgatacatgaagaacattccatgaagtatgttttaaaaccttgttatatctgagaggctttaaaagcctattaactgtttcagggcaaccgcggtacagacgtggtctctgtgagacttccacctgaccccagttttaagtggtacgaatgttgtgcatttaatgttaaaggacagtctgcaataataaagtaagtagccaacctgggtgcccagcagtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatgatcattgtaatatattttattgtatatgaagcatgactacttttagtgttaaataaactgcaataatccttatattgtgtataataa

SEQ ID NO: 10581 - DNA, 405 bp, Homo sapiens
ctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggcggcgggcgctgcgtcgctgcccagcgagctgatcgtgcacatcttctcttttctgccggcgcccgaccggctgcgggcctcggcctcctgctcgcactggcgtgagtgcctcttctatccggccctgtggccccagctccgcatctgcctccgcgtctcgcccgcggagcagcctcggctggaattcctcatgcgca

SEQ ID NO: 10582 - DNA, 3464 bp, Homo sapiens
ggatccgtggcccctcccccggccaaccgtcgattgggccggcgcgtgacgtcactccgttttagccaaacaaatgggtttcggggcgagcgttgggcgccgccgcgccgcgctgggtgctcggtccgactcagcggtggggagtgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgttttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatgg

SEQ ID NO: 10583 - DNA, 2831 bp, Homo sapiens
gatgtcactgcaggcccgggcggggacctgggctcacggaagggccggggggacccgcagggtagaaaaaggaagttgtcttccacgaacgcttggaatcgcagtggatttgaatcgaaagttgttcggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttac

SEQ ID NO: 10584 - DNA, 2810 bp, Homo sapiens
cggcggtggcgtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcaggtttttattagacatctattttatctaggcattagaaagggtaatggggcttttgaattttttcctggcattgtgtcgtctgcgtccagccatgaagctggtggctgagtgtccccaccaggaactgtgaagggcacgtaccacgggaggcactcagggtgggtgcagctgccttcccaactttgttctgctaagtccatattcagggccctatccttgtgagcccaggatgccagggtccatccccgcatgtagacagcttccgacctggtgctggagcatgactggagaagtgcaggcatcctgcttgcggaccttgctcaaagtacaacttcccaggactacttcacattgttaaataaacctataaacatttcttttcttttctttttttttttttttttgtattttctttttagtagaggtggagtttcgccatgtaggccaggctggtcttgaactcctgacctcaagtgatctacctgctctggcttccaaagtgctgggattacaggcatgagccactatgtctggctaaaacctataaacatttcttagagaaatgctgttccccaaaggaatgtgaacagctaccacttttaacaaggatatttaagaaaacagactatgagttaactaagtaaaaatgtaaatatggtttgcatgctgttaacatggcagaggggtaaaaagaatacagtcctggggagaaaggtcacttcactgagaaggcttacttaaaaatgtttttctccctgcactttcatgattattaagtacccctagaaaatgaactcatagcagcaaataatctaatgactccttttaggttacagagcaaagtagctttctacttccacatcacattataatatagccttataatttcttctttcctgcaaccttcactttcctacctaggaaaactcacctccggtgccagagaaacttcccaggatgcactagggccctgtgaacaatacagaagttgtggactctggctctttgtcccacctaagtccttccagaagggctctacagcatggcttagtgacattaaaaaaaaaaactgaacccatgttaatatcaaacaagattttaatcttcattcacacacccttaaaacccagtcacggggctccccggtgccagtttgagaccgtcaacctagccctctctgcttctcattgctggaggtacacacagtcaaaagttttccgtgactgtgaaatccagtgcaatctgcttcccagcagatgaggagcctgacgtggttatgtctggatttagtccaagaacagagcaaagctttaattgtcaagagacccaggcctcattctccacttaggagagtttgctagggcaggtacaggtaaaggtaaccagcaggcagctgagagcaagaaggcacgtgctctgcagagctctagctgccttggctctccctgagctcccagacttcactcatggcctaattttcaatgacagaacgtaggttttatcgtgaggatgcagacacaaccacaattacgtatgtcaacataacttcataaatatgtaactgtaacttattggtaacatcagtgcaagatgattaaagcttcatgtgtagtattttatcaacaaacagattctgaaagcttatggacatgcgcaatagttgattcagcttcaatcaataagaacataaatatggcaatttgaaaacactatgtatatacctactcacatatatattatacttacgatatatacttatatgtagtatataataatattacatataaaaatgttataaaaataaatgctaaagtaaataaaaaaagagccattaatatgttaactattgttaaataatagctaaaataatacagattattaaattattttaatactta

SEQ ID NO: 10585 - DNA, 3632 bp, Homo sapiens
aagtgtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttatt

SEQ ID NO: 10586 - DNA, 4424 bp, Homo sapiens
atgcgagcggcggcggaagcggaagtgcctcagcggtaggggccggggaagtgtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 10587 - DNA, 4132 bp, Homo sapiens
ccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatgaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 10588 - DNA, 3585 bp, Homo sapiens
aggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaactt

SEQ ID NO: 10589 - DNA, 1668 bp, Homo sapiens
atggagttggcgtcggagcaacagctgcgcgggcggagcagaaagcaagtgattgctttcctttcctcatttttggaagccctgcctaacacacagctgcactgtacatcccagttcctggatggacgaagaaagtgaactgatccagccccaagaccagagctgctgggcctttctgcccgatttgtgtctgtgccgtgttttctggtggctaggagacagggacaggtccagggctgctcttgtctgcagaaagtggaaccagatgatgtattctgctgagctctggcggtacagaaccatcaccttcagcgggagaccttccagggtacatgcatctgaagttgagtcagctgtttggtatgttaagaagtttggtcgttatctggagcacctggaggtcaaattcatgaatccttacaatgctgtcttgaccaagaagttccaggtcaccatgcggggcctcctgtcttgtctgagtaagagcaacaaccgtctgaaatctctttccatccaatacctggagctggaccgcctggtatggaggaacagcatcaggagctcattcatcagcagcttgagcttcttcttaaagaagatgggcaaacgcctggattatctcaacctaaaaggggccaggctgaccgtggagcaaggctgccaaattctcgactccctcagctacatgaggaatgagaatgtgatctcagagctcaacatcgaggactatttcagccatcaccttgctgtctacaacagcccccagttcaaaaagaccatgtccacattccacaatcttgtgtccctgaacctcaactacaactgtatctccgacgagctgcttgagaacttgtgtgagaatgccagcaccctccggaccatcaacatcaaatgccacgttcatgacccccacggacaggtcatctggggtatgtcctgggccaagctggccaggcaggccaccaatctgaaggtgaacttcttctttgaacggatcatgaagtacgaacgcttggcccgaatcctcttgcaggagatcccgatcaggagcatcagtctgagaagctgctatttcagtgacccagactgttcaatgagacccactctgatagatctcctgcccaccttccggcacactctgcagaaattaacttgtgaattcaacaacaaccatgagtcactcgacgaggagctgcacctcctcatcatatcctgcaggaagttgttttacttcaaaatctgggctttccttgatgttagttttgtggagcggatcctgaagagtcagaaagaacggcagtgtgccctgcgtgtattcaaggcgagaatttatacaaacagatatgagacgaatgaagaggacaagaccctgcaggaaatttacaggaagtacagaaagctgatcgaatcagagcttagctattttgtcatcgtttactctgtgatgtaatgagcactctacagatgaagaaagctgggagcactttgaacttgaaaatcatttctcttagaactacacttgggcactgccggcccttttgctcctctctctcccctccactttttttttttgtcagctccatgacaacatgaccagctcagcaaaggctgagactgcccatgacctgaaggctccaggtggctttaaagcgctatgtttaccaacta

SEQ ID NO: 10590 - DNA, 1682 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagacatgaatggcaagatgaattttctcatattatggcaatgacagatccagcctttgggtcttcgggaagaccattgttggttttatcttgtatttctcaaggggatgtaaaaagaatgccctgtttttatttggctcatgagctgcatctgaatcttctaaatcacccatggctggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaagtttgtgcctctcattccctgagtttctattcttttgggtataaagattgccttagtgagaaatagcaaatttgctaaactttctattcagtcttttcaagggttcataagtggttatcagaaaagaaatttttatctattcttaataaatacactgcttaaagactgaaaaa

SEQ ID NO: 10591 - DNA, 1731 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagtaagtactcatatgtacatttttaagcacattgttcttttcaaagcaaatggaaaatacctttttagactttactgtggcttcttaagaatatgatggcttattttatcaatgtgattttctgacccttactattaatagtgtgttctcacacttttgtgtgtattaggatcacctgggaagcttgttaaacatgttaacaagctgattcctaccctggtggattttattcctagatttgggttgtgtgaatcagatttgggcatctgttttttccaagcacccagggaattctgatgcattccaaagtttggtactagagctatacaatatttttttgctttatgcttctgcatttttttgatactgacattttgtctgcttctggctttattcaaataatctatgcaaataactatgaaaaattttatctttgttttatccaaatagtaaagagatgtgatggtagggtgttaagtagattagttgagaacactattcatatattctgaataattgccattcagaatgctatttttgtgtgaaatcaaaatatcattgggccatgagctagtattataatatctttcccaaatcctttgtgaacaaggtagaatataaatacataatatattgtatatatattatagttctctaatacactggtttgaatttctattcaatttattttccctgtgatctgttaggcatgaaagcagttgcaattactttctgttattacagggctatctataaaaagaaaacttagaagcaaaa

SEQ ID NO: 10592 - DNA, 5926 bp, Homo sapiens
ctgttctggccttgaaaatgatccttcttaaaaggattttcctccttcctcaagggaaagaaaacctattgatataaaacttcacttcccattcagtttcccctgctaaatgccactccagtagagactgagtgttgataaatacaggggaaggaaaaagtcgtaagctgagcctggtcacattgccccttgtgatatcgttttatttttaacttcgcaacacttggactatttctgttgaagttttctctcctttccctgccttcccaacagaacgctgtcctctactgcagctgatgcaacccagccacctcccggcaatccgcttacttgcaatcaagggttcaggtgcaagcagatgctgactcagcctgttccattaagagctaagaagcaagaagaaattggggcgccatggggaaagcccgcagatccccgccagggcaccacaggcattgtgagggatgcttcaaccgccactgccacattcctgtggaacccaacacctcctgcctggtaataagctgccacctgctctgtggtgccaccttccacatgtgcaaagaggcagagcaccagctcctctgccctttagagcaggttccgtgcctcaactccgaatatggctgccctctgtccatgtcccgccacaaactggccaagcacctgcaggtgtgccccgccagcgtggtctgctgctccatggagtggaaccgctggccaaatgtggactctgaaaccacccttcatgaaaacatcatgaaagagacccccagtgaggagtgtttggacacagccctggccctgcaggatcagaaggtcctcttcagatccttgaaaatggtggaacttttcccagaaactagagaggctactgaggaggaaccaactatgaatggtgaaaccagtgtggaggaaatgggaggagcagtgggtggagtggatatcggtttggtaccacatggtctgtcagcaactaatggggagatggcagagctaagtcaagaagaacgggaggtgctagccaaaaccaaagaagggatggacctggtcaagtttggccagtgggaaaatattttcagcaaagagcacgcagcctctgctttaacaaattcatcagcgagctgtgagagcaagaacaagaatgactccgagaaagaacagatttccagtggccataacatggtagaaggagagggcgctcccaaaaagaaagaaccacaggaaaatcagaagcagcaggacgttcgtacagccatggaaaccacagggcttgccccttggcaggatggtgttctggaaagactgaaaacagctgtggatgcaaaggactataacatgtatctagtgcacaatgggcggatgctgatacactttggtcagatgcctgcttgtacacccaaggagagagactttgtttatggcaagctggaggctcaggaagttaagactgtttacaccttcaaagttcctgtgagctactgtggaaagcgagctcgacttggagatgccatgttgagttgtaagccaagtgaacacaaggcagtggatacttcagatttggggatcactgtggaggacctgcccaaatcagatctcatcaagaccaccctccagtgtgctttggaaagagaactcaaaggccacgtcatctctgaatccagaagcattgatggactgttcatggattttgccacacaaacatacaactttgagccagaacagttttcctctgggacagtgctggctgacctaaccgctgccaccccagggggactccacgtggagctccacagcgagtgtgtgaccaggagacacaacaaaagcagctctgccttcactttcacttgcaacaaattcttcaggagggatgagttccccctgcacttcaagaatgtccacacagacattcagtcatgtctcaatggctggttccagcatcgatgccccctcgcctacttgggatgtacatttgttcaaaaccatttccgtcccccagggcaaaaggcaaaagtaatctatagccaggagctcaagacctttgccattaagccggaggttgctccagagctgagcgagggaaggaagaacaaccatcttttgggtcatggaggaaaaagccagaattctttaaccagcctgcccctggagattttgaagtacattgctgggttcttggacagcgtcagcctggcccagctctcccaggtgtctgtgctgatgaggaatatctgtgccactttgttacaagagagaggaatggtccttttgcaatggaagaaaaagaggtattcccatggaggcacctcctggagagtccacagagagatctggcagttcagcagcctcttctccaaaatcaagagctgggagtttaatgaagtcacctccatgtctgagcacctgaagtcctgtcctttcaacattgtagagcacaaaactgacccgattcttttgactagcatgtgtcagccccgtgagcaggcccgagagagcttagtctccacctttagaatcagaccacgaggaagatacgtctcctaaaaattcagatgccactcgatgcacccttcttggatttcttctcggagttcctgaagtaggacagagtgtgtggttttgaggactcccttctgtaaactgcctatttgcttatcggggtgtattggaacacgcaatgtccttcgaaacctcaacacgaggcctaagaatttcctaagccatgtcttgtaccatagtgccacattgatgacttgtttccttttttcttttcttttcttttcttttttctttctttctaaaatagattggtctgagaagaaaataagtaatttgaggccatttggaagatgggcccaatttcttaagtgatgagagagcacgaaattccataaccagtacaggcctgtgcttttacatgggctttttagttcacaaagcactttcaaatttatgggacaggaaatgcaggatgggactccccagggaacgcagggtgaagggaacaaagctggaggctctggagctgggtctgttttgacggtcaagtccagggctcattttggttattctactgcctctaggccagggtagtcctaacacagcctgacataggagagcccctggctgagcatggcagccttgaagacaccacaggccaaaacatgaggggcagaaatgggatcacagagtctgttgctagaatcttggcaacatacagcaggaaagccttgataaatcgggagtccaaaggagacaccatatttatggagaacattaggacaaaaagtcaccaacttactttgtaacattttaataatgacttaagggtcaagatttttttcttctgaaaattatgttctgagttaggcagaacatagccatggccctgggccaccctgtgctatctgaaatgacctcaatacactaatgccaacctcagcgtcatgccagaatgcacagggcagcccagggagatcacacctttggcaaagtccagacaaggcccactgcagttcctatggcgccagtcaccagctcctagacagcacttgggtaccccattggggtcttggagaggaagacatgtgaacataacggctccctgaaattgctcctacccatccatatttctggtcatgctttcagtctgacaaaaatggatgatactgctgtttttggtaacaaacagtgaatattcataagaacaaaagtaaaagaaaaaaagacacagtagaaactggcatcccctaaagcagggcttcttagccttggaactattgacatttttaaatggataattctttttttttttttctaggtggggaggggatggagttcactcttgttgcccaggctggagcgcaatgacatgatctcggctcaccgcaacctccgcctcctgggttcaagcgattctcctgcctcagcctcccgagtagctgggattactcgcctggctaattttgtatttttagtagagacgggctttctccatgttgttcaggctggtctcaaactcccgacctcaggtgactcgcccgccttggccttccaaagtgctgggtttacaggtgtgagccactgcgccctgcctgaactggataattctttgttgcaagggactgttctgtgtactacaggatacttggcagcatccttggcctatccattaaatgtcagtagcacccccacagtggcaacaatcaaaaatgtcaccagacattgctaaatattggggagcaaaatggctccccgttgaaaatccctaaaggatgtcatactagtgacaataagttaggatatgcttattttttagtacagcaaaatcttatcgcacatagctatccacaatagttatgatttaatgcagctctttatttatgaaataggttttagacatgtggtgattttaagttgggaaccagaaggaaatgattcgtttggtatggcttcatgtccttcagccacccccaagaatgtatcctttcagctctctttggttatacctgaagccaggagcgttgagttattagccttgtgtttatattcctctcactgtaattggtgtcattttcccagcagtcctagcagtcctcaagcaagtgggaaatcggaaaagaaaaggacaggcattgtagggaagcagaggataaagaatttagccaacaaaagaaacaatctagtcaatctgggtgcttttatttcctgggttctctctaaacatggctcagagctggtgtagatgaagtaggtgaaacctctgaaaagagtctagaaggcagtagagcaagtcccagaccagaaacatgctcatcttttcatcgtaatgtgccactcggtactatttggtaatgtcactctatttttcctaatcccatcctttggtttgtatttcatatttgtatataaggcaccattttctaaaaatatgactagggtgtgacctaaggttttattctgtgaagatgagtaactggaaagaagctaacactgcagtgggaaggaaggaagagagttgtccaggtggtagttcgacgtgttttgaatctagtccttcctacatggaggataaaagctcctaaagtccactctgggtttgtgattttaatagaaatagaaagggaaactatagaccaatggagatgaaaatcaggggctatcgacagatggaggagaaataaggtgctacatagagaaaggaagagggcagaaggctttcccttcccaaactgggtgagctggggaagccttggttcaggagagtggcactgcccacaactgctttgtgggttgtgcacttccagccgcactctccccctccagttgctgccttcagagccgtactgaagcacgagcttcaataagacaagcacacttcatagtgagagggcagcggtaccaaagcctttcagagagactatggattagacagaaatgatttgtgagaggaagctggagtgaacagcatgaacagcgagtgttacctgacagaggcaagacagctagaagtggcttcagatttagaaacagctgaggggagcaaagacggactgtgtacacagggagggaggatgtctatgggcagagcccttggtgagtatcatcaccaagaaaggcagtccagagtagagatcagccgaatatggaggctgaggtctgtagaactgggccagagaggaccttactgccttagtagcataagggtctggaaaagaagtttctatctcacaacaaaggaaaaagtgaaaagcaaggtggaacttgaagatacgtcacgaaaatcactataaaagtctgatttatgtgtgatgtcaaatcaaactgaaatgaagaatgagattgagtatatctgtggtgactgacctctgtatactagaaacctcaacatctctagaagaggaaataaaagctgctttgcactctg

SEQ ID NO: 10593 - DNA, 7111 bp, Homo sapiens
atgacaactggcttgtctgatcagcaggtggtctgtgaccttgatcacagggcagtggaagccctattgcaggcagttaggaagaggatggcaggggcctcgcccgcggtcccccatgagcgcgcccggctgaccggcggggcggccgcggtggagcccgcgtgccgcgggggcggcggggccatggcctcgctggacctgccgtaccgctgcccccgctgcggggagcacaagcgcttccggagcctgtcgtcgctgcgcgcgcacctggagtacagccacacctacgagacgctctacatcctctccaagaccaacagcatctgcgacggcgccgccgccgccgcggccgccgccgccgctgcctcggggttcccgctggctcccgagcccgccgccctgctggccgtgcccggcgcccggcgagaggtcttcgagagcacttccttccagggcaaggagcaggcggccgggccgtcgcccgcggcgccgcacctgctgcaccaccaccatcaccacgctcccctcgcccacttccccggcgacctggtgcccgctagcctgccctgtgaggagttggccgagccgggccttgtgcccgccgcagcagcgcgctatgcgctgcgcgagatcgagatcccgctgggggagctgttcgcccgcaagtccgtggcgtcctcggcgtgctcgacgccgccgcctggccccggccccggcccttgccccgggcctgcctccgcttcgcccgcgtccccctcacccgctgatgtggcctacgaagagggcctggcgcgcctcaagatccgcgcgctggagaagctggaggtggaccggcggctggagcggctgagcgaggaggtggagcagaagatcgcgggccaggtgggccggctgcaggccgagctggagcgcaaggcggccgaactggagactgcgcggcaggagagtgcgaggctcgggcgcgagaaggaggagctggaggagcgcgcgtctgagctctcccgccaggtggacgtgagcgtagagctgctggcctcactcaagcaggacctggtgcacaaggaacaggagctgagccgcaagcagcaggaggtggtgcagatcgaccagttcctgaaggagacggcggcgcgggaggccagcgccaagctgcggctgcagcagttcattgaggagctccttgagcgggctgaccgtgccgagcggcagctgcaggtcatcagcagcagctgtggcagcacgcccagcgccagcctgggccgtggaggtgggggcggtggtgctggacccaatgcccggggcccaggcagaatgcgagaacaccacgtgggcccggccgtgcctaacacatatgcagtgtcacggcatggctcctctccgagcacaggggcctccagccgtgtgccagccgcatcccagagctcaggctgctatgacagtgacagtctggagctgcccaggccagaggagggggcccctgaggacagtggccctgggggcttgggcacacgggcccaggctgccaacgggggctcagagcggtcccagccccctcgcagctcaggcctgcggcgccaggccatccagaactggcagcgcagaccccgccgacacagcactgagggggaagagggtgatgtctccgacgttggctcccgaaccactgagtcagaggctgagggcccgttggatgcgccccgccccgggcctgctatggctgggccattgagcagctgccggctctcagcccgccccgagggaggcagtgggcggggtcggcgagcagagagggtcagcccctcacgctccaatgaggtcatcagcccagagatcctgaagatgcgagctgccctcttctgcatcttcacctacctggacacgcgcacactgctgcatgctgccgaggtctgccgggactggcgcttcgtggcccgccaccccgcagtctggacaagggtgctgcttgagaatgcccgtgtctgctccaagttcctggcaatgctggctcagtggtgcacccaggcccactctctgacgctgcagaacttgaagccccggcagcggggaaagaaggagagcaaggaggagtatgcccggagcacccggggctgcctggaagctgggctggagtccctgctgaaggcagctggggggaacctgctgatcctgcgcatctcccactgtccaaacatcctcaccgaccgctcgctctggctggccagctgctactgccgtgccctgcaggctgtcacgtacaggagtgccacagaccccgtgggccatgaggtcatttgggccctgggcgcaggctgcagagagatcgtctccctccaagtggcaccacttcacccctgccagcagcccacacgcttcagtaaccgctgcctgcagatgattggtcgctgttggccccacctgcgggccctgggggtcgggggtgccggctgtggggtgcagggcctggcatcactcgcgagaaactgcatgcggctgcaggtcctggagcttgaccacgtgtcagagatcacccaggaggtggcagcagaggtctgccgggaaggcctgaagggactggagatgctggtgctcacggcgactcccgtcacccctaaggccctactgcacttcaacagcatctgccggaacctcaagtccattgtggtccagattgggattgcggattatttcaaagagcccagcagccctgaggcccagaagctgtttgaggacatggtgacaaaactccaggctctgcgacggaggcccggcttctctaagattctgcacatcaaggtggaaggcggctgctaacccgggtagggggcggcagggcccctgccagccccacaccagggcactctctttggacctcagagggaccctggtttggactagacctttggaggccgagtgttatccctggcttctggagggggactgtcaagtctcctgtcctcctcctggagcagcagagcaacaggcctgacccagggcactgcctccccagtacaggggcttggacagaagctgccctccgacccccaccctaccccggctggagtagcctctggcacagccagtgaggagctgtcaccaccagcgcctggtgtcatcacctggaggatctgcaataaccacccagtggctcctcagctgttctggctggcctctccttcctgaggcccagcctcctggtcaggagcatctggggccccaagccaatgggggctccacaaggcagctcagacttggcaaggagggctcttctcctcaaccttgctgcagccttctgggggcaccccttcagacagcctgcccaggctgtggatccacatttcctgggggtaccacagccagacctaggggcctgggcacgtggtcagccaaaagctgggggcagcagtacagtggggtagtgggggtgggtttggaaaggaaacagtcacccagaacttctccccaggatgagaccacccttccaaggtgggggattgccagggggagaaaacttatttattgctgtaagacaggacccctcctcccaacctcataccccaccgcacaccagagctaaattcaaagctgaaaggcgcacgtttctatacctacattcattcctgagggaccctccagagggtcaaggtcccagccccaggcagccctgtcacagtgagaagtagttcctgtccttaaggaatttccttctaatccaggtgcttgggcaggaacccgatggccttcgggtcaccaaggctgtctgggagggaggcacagggccgccctctgtgctgaggccgtggaggaagccaggaggagggtggcttgctttgcttccttgtctaattagcttgcttgaagatgtggccttggcagggagccagacccatggggccaaggaagaggaagagcatcctcaatagactcactcccccttccttggtctccacgggccccgtggactgagggctgcattggggtcttctgcctaggggaagtgctggacctgagctggagccacttggcttagaagccacaggattcacttttcactggcctttgcagtccccaaaggatcaggtctcagaaccaaggctccaaaggctgaggtctccccagttcctcctctcagaactcccacagtagctcagaggccgggggtcctgccaactttcatttggaaagttctttcgaacatctaaactagatctatcttagggtttctttctctcctagataggatcagctcccagccctagccattaggctgctggtcctggcgggggatggggtcccctcgttacccagtccttcccagggacccaacttcctaacacaacctggcttggacatgaagaccctcccccaggttaccttgtaaagagtcctccagagctgggatcccatgggcgcagcagcacacccagctcccatggcgtcactccctagctctgtcccagcttttgctatcattgctgacttttcctcctgtggctcattctgtccctgccctttgaaaacctaaaataccaagggtgtcatgctggcaactccctgcccagtcctgcacaaagccttggctgtgtgtggcaccccttgcctcctaccccagagcagctggctccattggcttctccctgcaccagccctgtcctcaggggtcaggaaaaagcagcacagctttctttcctctcctccagaggcctggaagggaggtggaggtccagtaagggcctggctgccttggatttcttggtcctgccttgccaactgcaccctgtagctcctgctccctgtgaccccagaaccagaggtgctgccttccctgtctcctagacaaagcacaaagggatgccctgcttggcttgagcctgcccaactgaaggattttctctgccccagggaccttccatccctgaatacaaggctctaggcaacttctctctgggtggtacacactagaatgcctggcattagccctagaaaggaggttggggtgtatgggtagtgagctagggtgggagaaaggtggtgctgaaaggacagatgctagttgtagtttcactcactcattcattcattagtgcaacagtactgagcaccacctgcactagaggcagaggggtgaacaagatacccttctgcctggggggacgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacagcctttccccagccaggagagaccacctaaggatcaaggcagctcctgttttcttggttctgtgacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgaggccaagcctcctctgccactgccagcatggcccaagggaggcttggccttgggcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggccctaccttcctacacagctaggctataatgggcctgagtgagagggtagcttccccagccccaagcacaggcagaggggtggagagcaatttttggttttatttttgtttctgaagtggtgcctgtacctccagcccccagggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggtctatctgcc

SEQ ID NO: 10594 - DNA, 7336 bp, Homo sapiens
gcgccccctcctccccctcctcctcctcctcctcctccatccttcctcccgccgggttcgtgcgcccctcccgctgcgactggctgggaggttcggccgcccccgccccgagagggaggcgggggcgctagccgcggcggccacccaaggctgcggaggggaacgagatccgaggccccaaggcggccctgcgtctggaccgggcacgcgggggctcttctgcgtccccagccctgggccgctgggcctggcctcgccgcggggtggaggaggtaaggcctcctcgccccaggccgcgggcgccctgagccttcctgaccccgcagggggcctcgcccgcggtcccccatgagcgcgcccggctgaccggcggggcggccgcggtggagcccgcgtgccgcgggggcggcggggccatggcctcgctggacctgccgtaccgctgcccccgctgcggggagcacaagcgcttccggagcctgtcgtcgctgcgcgcgcacctggagtacagccacacctacgagacgctctacatcctctccaagaccaacagcatctgcgacggcgccgccgccgccgcggccgccgccgccgctgcctcggggttcccgctggctcccgagcccgccgccctgctggccgtgcccggcgcccggcgagaggtcttcgagagcacttccttccagggcaaggagcaggcggccgggccgtcgcccgcggcgccgcacctgctgcaccaccaccatcaccacgctcccctcgcccacttccccggcgacctggtgcccgctagcctgccctgtgaggagttggccgagccgggccttgtgcccgccgcagcagcgcgctatgcgctgcgcgagatcgagatcccgctgggggagctgttcgcccgcaagtccgtggcgtcctcggcgtgctcgacgccgccgcctggccccggccccggcccttgccccgggcctgcctccgcttcgcccgcgtccccctcacccgctgatgtggcctacgaagagggcctggcgcgcctcaagatccgcgcgctggagaagctggaggtggaccggcggctggagcggctgagcgaggaggtggagcagaagatcgcgggccaggtgggccggctgcaggccgagctggagcgcaaggcggccgaactggagactgcgcggcaggagagtgcgaggctcgggcgcgagaaggaggagctggaggagcgcgcgtctgagctctcccgccaggtggacgtgagcgtagagctgctggcctcactcaagcaggacctggtgcacaaggaacaggagctgagccgcaagcagcaggaggtggtgcagatcgaccagttcctgaaggagacggcggcgcgggaggccagcgccaagctgcggctgcagcagttcattgaggagctccttgagcgggctgaccgtgccgagcggcagctgcaggtcatcagcagcagctgtggcagcacgcccagcgccagcctgggccgtggaggtgggggcggtggtgctggacccaatgcccggggcccaggcagaatgcgagaacaccacgtgggcccggccgtgcctaacacatatgcagtgtcacggcatggctcctctccgagcacaggggcctccagccgtgtgccagccgcatcccagagctcaggctgctatgacagtgacagtctggagctgcccaggccagaggagggggcccctgaggacagtggccctgggggcttgggcacacgggcccaggctgccaacgggggctcagagcggtcccagccccctcgcagctcaggcctgcggcgccaggccatccagaactggcagcgcagaccccgccgacacagcactgagggggaagagggtgatgtctccgacgttggctcccgaaccactgagtcagaggctgagggcccgttggatgcgccccgccccgggcctgctatggctgggccattgagcagctgccggctctcagcccgccccgagggaggcagtgggcggggtcggcgagcagagagggtcagcccctcacgctccaatgaggtcatcagcccagagatcctgaagatgcgagctgccctcttctgcatcttcacctacctggacacgcgcacactgctgcatgctgccgaggtctgccgggactggcgcttcgtggcccgccaccccgcagtctggacaagggtgctgcttgagaatgcccgtgtctgctccaagttcctggcaatgctggctcagtggtgcacccaggcccactctctgacgctgcagaacttgaagccccggcagcggggaaagaaggagagcaaggaggagtatgcccggagcacccggggctgcctggaagctgggctggagtccctgctgaaggcagctggggggaacctgctgatcctgcgcatctcccactgtccaaacatcctcaccgaccgctcgctctggctggccagctgctactgccgtgccctgcaggctgtcacgtacaggagtgccacagaccccgtgggccatgaggtcatttgggccctgggcgcaggctgcagagagatcgtctccctccaagtggcaccacttcacccctgccagcagcccacacgcttcagtaaccgctgcctgcagatgattggtcgctgttggccccacctgcgggccctgggggtcgggggtgccggctgtggggtgcagggcctggcatcactcgcgagaaactgcatgcggctgcaggtcctggagcttgaccacgtgtcagagatcacccaggaggtggcagcagaggtctgccgggaaggcctgaagggactggagatgctggtgctcacggcgactcccgtcacccctaaggccctactgcacttcaacagcatctgccggaacctcaagtccattgtggtccagattgggattgcggattatttcaaagagcccagcagccctgaggcccagaagctgtttgaggacatggtgacaaaactccaggctctgcgacggaggcccggcttctctaagattctgcacatcaaggtggaaggcggctgctaacccgggtagggggcggcagggcccctgccagccccacaccagggcactctctttggacctcagagggaccctggtttggactagacctttggaggccgagtgttatccctggcttctggagggggactgtcaagtctcctgtcctcctcctggagcagcagagcaacaggcctgacccagggcactgcctccccagtacaggggcttggacagaagctgccctccgacccccaccctaccccggctggagtagcctctggcacagccagtgaggagctgtcaccaccagcgcctggtgtcatcacctggaggatctgcaataaccacccagtggctcctcagctgttctggctggcctctccttcctgaggcccagcctcctggtcaggagcatctggggccccaagccaatgggggctccacaaggcagctcagacttggcaaggagggctcttctcctcaaccttgctgcagccttctgggggcaccccttcagacagcctgcccaggctgtggatccacatttcctgggggtaccacagccagacctaggggcctgggcacgtggtcagccaaaagctgggggcagcagtacagtggggtagtgggggtgggtttggaaaggaaacagtcacccagaacttctccccaggatgagaccacccttccaaggtgggggattgccagggggagaaaacttatttattgctgtaagacaggacccctcctcccaacctcataccccaccgcacaccagagctaaattcaaagctgaaaggcgcacgtttctatacctacattcattcctgagggaccctccagagggtcaaggtcccagccccaggcagccctgtcacagtgagaagtagttcctgtccttaaggaatttccttctaatccaggtgcttgggcaggaacccgatggccttcgggtcaccaaggctgtctgggagggaggcacagggccgccctctgtgctgaggccgtggaggaagccaggaggagggtggcttgctttgcttccttgtctaattagcttgcttgaagatgtggccttggcagggagccagacccatggggccaaggaagaggaagagcatcctcaatagactcactcccccttccttggtctccacgggccccgtggactgagggctgcattggggtcttctgcctaggggaagtgctggacctgagctggagccacttggcttagaagccacaggattcacttttcactggcctttgcagtccccaaaggatcaggtctcagaaccaaggctccaaaggctgaggtctccccagttcctcctctcagaactcccacagtagctcagaggccgggggtcctgccaactttcatttggaaagttctttcgaacatctaaactagatctatcttagggtttctttctctcctagataggatcagctcccagccctagccattaggctgctggtcctggcgggggatggggtcccctcgttacccagtccttcccagggacccaacttcctaacacaacctggcttggacatgaagaccctcccccaggttaccttgtaaagagtcctccagagctgggatcccatgggcgcagcagcacacccagctcccatggcgtcactccctagctctgtcccagcttttgctatcattgctgacttttcctcctgtggctcattctgtccctgccctttgaaaacctaaaataccaagggtgtcatgctggcaactccctgcccagtcctgcacaaagccttggctgtgtgtggcaccccttgcctcctaccccagagcagctggctccattggcttctccctgcaccagccctgtcctcaggggtcaggaaaaagcagcacagctttctttcctctcctccagaggcctggaagggaggtggaggtccagtaagggcctggctgccttggatttcttggtcctgccttgccaactgcaccctgtagctcctgctccctgtgaccccagaaccagaggtgctgccttccctgtctcctagacaaagcacaaagggatgccctgcttggcttgagcctgcccaactgaaggattttctctgccccagggaccttccatccctgaatacaaggctctaggcaacttctctctgggtggtacacactagaatgcctggcattagccctagaaaggaggttggggtgtatgggtagtgagctagggtgggagaaaggtggtgctgaaaggacagatgctagttgtagtttcactcactcattcattcattagtgcaacagtactgagcaccacctgcactagaggcagaggggtgaacaagatacccttctgcctggggggacgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacagcctttccccagccaggagagaccacctaaggatcaaggcagctcctgttttcttggttctgtgacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgaggccaagcctcctctgccactgccagcatggcccaagggaggcttggccttgggcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggccctaccttcctacacagctaggctataatgggcctgagtgagagggtagcttccccagccccaagcacaggcagaggggtggagagcaatttttggttttatttttgtttctgaagtggtgcctgtacctccagcccccagggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggtc

SEQ ID NO: 10595 - DNA, 6202 bp, Homo sapiens
agcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatacagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaac

SEQ ID NO: 10596 - DNA, 945 bp, Homo sapiens
gtctttcagttaggacgggagagggaggagggagtcaggtttattttcaatgtcttcccctcctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctct

SEQ ID NO: 10597 - DNA, 1153 bp, Homo sapiens
ctttgctgtgtcatttctcaagagaatcctgcattttatgtggttgacattcatgttaatatttgatcaacaaagaatgtatcctttcaggtgaattatcagtaatttattcacagggatcagaattgatatgtttttaggagaatggagaggttatggtaactagaatattcccatttgggagctaggtaggctattctcatataccagtgaagcatagaaagtcagaaacctgtgtctttgtaggtttattttcaatgtcttcccctcctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctct

SEQ ID NO: 10598 - DNA, 2886 bp, Homo sapiens
gaccgttacccacccgcccgccatagctcctcgggggagtcagtgccaggctgcagcacacgctgccttttcaggaacccgaatttgggaagtttactcatgtctaagtccagctggagaaaacaaggatattaagataactattttctggagggctgaaggaaattcaaaatgatttagaccttctcaagtgttaggaataatccctgcggcatgcaccctgtgtacccttcgactttgagcaatcatgatgctgctgcacctttcaattaattgtgcaaactaaagttttcctctttaagtggcattattttggcatgagttttaaagacaaagatgagagaatttcttgtttggaagcctacgtaactttgacatctaagagctcaagatttactgatgaaacagagattttgaagatgtcgcaaaggcactcaggtcaagctggcactgaagcaggaaatggggcggactctcctccaattgtcaactccaagtactccaccttcagagatttttgttccacatcttcatttcaagatagtggctacaatgagttaaaatcttgtagctttgataatatagataaagaatatcttggaaagaaagaaaaaggcccaacattactctatgagcaccctgaaacttcaggcctgggcttaacacatcctttagaatctcccactcaaaaaaagaaatgtatcttgcctagaaaggaaaaggataaaaccccagaactttgtgaaacacctaaaatcagtgggaaaaaatgtttacctcgcagaaggttgaatgtatctttcgctcttctaaaaggggactttgaatcacaaaatagttctttagaaagtagtataagccaagttatcaacttagaaaaaaatattccaagcagtgcttcaggtttttccagggcaaataattttagccctttagttactagcactttaaaaacagaagaagtgacttcatgcagtcaaaaattgaggcttaatttttctcagcaaaagacttccacaattgatgattccaaagatgattgtagcctatttgaagttgaatgtatatctccaattcagggcaataattttaaagactctatcacacatgactttagtgatagcagtttatgcattaatgatgagaatgcatgtccagagctcctgggctcctctgttagtggaacaacttgtggaacagatgaggacatatttgtgactccgataagtaatcttgtggcaaacattagatttaacgcaagtcaaatactttctccttcacctgaagtgagaggcagtatttcaacgcctgaagacagtggttttaactcacttagcttggagaaatcagaagattccctgtctgaccaggagggttcttttcaagaactactgcagaaacataaggggactcccaaagttggggacaccataagaaagacaagacatcttggaaggtcgagaagactgtccacccttcgggaacaaagctcgcagtcagagacagaagaggaaaagcagattgtccaccctgactctgaaaaaagagcagcagctgcttctgccatctcagagggtcagctgagtagtgatgagagtggggatttgacctttagcttaaagaatttatcaaagaccccagccttgcaattggtacatgagctgttcatgaaaagcaagaggaaaagattacaggaaaatagtggacatgaattcttagagcaaggggatggggagaaaatagctgtactgcagtgtatacttgcaggactgatcggcaagaaaatgggtatagaaaaactggacatcttaacagaattaaaatatagaaatttaaagcatattcttgctatggttttagagtccttgaccgcagagagcctatgcagtgtttggaaagtaagcagaaattggcgtgaaattgttgttcaagataaaaatgcaaatcggaggaggaaattttatatcacacaactgaaaacagattctgagggggctgtattaaatgtcgaggatgctgccactcggctccagcttttaaatcgctcagctttaagatctgtgcaggcacaggctaggatacctggttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagccgaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatatagaactcccccatgcagtgttctatttatctgacttaaaattatgaatattttgaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgttatatgtatgtactttattgttttatgtaacattttaaatttgtgcatttcatcactcttgacatgttcttcaatcattttttaaaaaatagtttttcagataatattaaagattttgaactctagacagatggccttatagatttggaaaatgagtacttgactgaaatgaaatataaataaaatattttcagaagt

SEQ ID NO: 10599 - DNA, 1896 bp, Homo sapiens
agcgctgcgggctgcgcgagtcccggggcggcgagtcccggcgctgtccgcgtctgtgtcggtcccggcgaccgcgcctcttaaaggcccccgacccgacccgccccgccccgcctctggccccgcgcccggccgccccgcagtcccagcagtctgctcgaggcccggggctgcgggttcctcagcggaccgaggaggctgggaaagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtct

SEQ ID NO: 10600 - DNA, 2903 bp, Homo sapiens
ggcggtgcagcttgggcggcccaacggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatc

SEQ ID NO: 10601 - DNA, 822 bp, Homo sapiens
gcttgggcggcccaacggatcgtgccgcggcggccgagcgcagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggg

SEQ ID NO: 10602 - DNA, 1734 bp, Homo sapiens
gcttgggcggcccaacggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 10603 - DNA, 959 bp, Homo sapiens
tccaggcaagcgcaggtccaggcggtgcagcttgggcggcccaacggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccc

SEQ ID NO: 10604 - DNA, 3320 bp, Homo sapiens
gcgggccggggcggggcctcgctttccaggcaagcgcaggtccaggcggtgcagcttgggcggcccaacggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatca

SEQ ID NO: 10605 - DNA, 994 bp, Homo sapiens
gcgggccggggcggggcctcgctttccaggcaagcgcaggtccaggcggtgcagcttgggcggcccaacggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagg

SEQ ID NO: 10606 - DNA, 5899 bp, Homo sapiens
ggcggagccgctggcgcgccgcggagaggccgggcgagtcgggcggtttcggcgcccgcgctgagccgcggaggaggggcggaggacgcccctgcagccggtgcgtctgccctcagtgaggcggggcgcgcggcggacgcccccgggcaggggcgggagtggtggaggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaatttgtggttaatgtcatttcatagttgccattattttctcattatttgacttaaatgttaagccatttatttcatctccctcattcacataaagtgtagatatggattcaataagacaccaaaagaaagtaagatttacccagttaatatttaaaatcattgttcagtgattaggcattttctgccttttagaattatttgactggagaaagagtttcaaaaatagcagagccctaaaccataaagaaactactactgtataatgaacttttgtttgtttttggagacagggtttcactctactgcctaggcaggtcttgaactcctgggctcaagcagtcttcctgcctcagcctcccaagtagctgggattacaggtgtatgccactatacccagctttaacttttaaatccccaaactatgtagattgtcatattaatattaatttttttttgttattttgaagaagtgagtaatttgaagagatagaaacttagggagtggtgtgtgtgtttcttttttggagacagagtcacgcaggctggagtgcacgatcttgactcactgcaacctttgccacccaggttcaagcaattctcgtgcctcagcctcccgagtagcatgtgccaccacacctggctaatttttttcttttttcttttagacggagtcttgctctgttgcccaggctggagtgcggtggtgtgatctcagttcactgcaacctttgcctcccgggttcaagtgattctcctgcctcagtctcccgagtagctgggattacaggcacctgccaccatgcctggctaatttttgtatttttaatagagacggggtttcaccatgttggccaggctggtctcgaactcctgaccttgtgatccacccacctcagcctcccaaagtgctgggattacaggcatgagccactgttcccgggcctaatctttgtatttttagtagagggggtttatgccatgttggccaggctggtcttgaactcctggccaacaccacccacctcgcctcccaaagtgctggggttacaggcgcgagccaccgtgccaggccagaaatttaaggagttttaaaggttagcattgaaaagattactttccagaaattgagaccaccacagttccacaattgggactgtggtagataatcaggaccacttggaagcctttattaggaacagcccacacccagcccaaatgctgtcctcaaaaacattcctcagtttctctagctgaatgtaatctctccttgaaatttccctagttttatatatctatagttgactcatgctgtatttatttataccttgtttaaaattatttattgattatttattggtgtcatatcgcccctaaactgggacaggatctctaacggactcatctttgtgccacaacatgtaagcccaataggcaggtgctcacatatttgctgaaggaacagagaaagaactgcggagaaagacaaaagctcctctgaagttttagactatagaagcaaaaattatagtagcaaaagatgaatgagaaattctgttctagtcccagtgaagcaggaaggaaagggttgcaaacttgaggctggtaaggaagaaataattactgtgaatgcatttagccactcccctctactcaaaaatactggtaaactctgatttttatatttgtttagaatttaaattagaattctgtatctttattttttggaattctgttgttttgccttagtttcttaataaaaagttaaacattaa

SEQ ID NO: 10607 - DNA, 2990 bp, Homo sapiens
tgggggaaacccgcgtagccgagggagatgcagcgcgcggcgatggtggcatgtggagcctcccaccaccacctaggtcctgagatgcgctgaagcccagcctgtctgccatcatcccccagcatggaccgtgggagcctcctgcccttccagctatggtgcccccggccctttggcacctactcacagaaccagccacgcccgccttctgcggccctcaagccatcagcctgccctgagcctggtggcggggccgagccagaccatgggcctgcccactcagagaacacaccacccgccttggccactgaggtccctgcctcccagccggctccgctcctctcagcagcagctgctggtgatgagggtcgagtcctcctggacacgtggtatgtcatcaagcccgggaatacaaaggagaaggtggccttctttgtggcccaccagtgtggtgggggcagccgggccagctccatgaaggtcaaggggcactggggcagcgatagctccaaggccaagcggcggaggcgctgtcttgaccccaccaaggctcctcctgacccagggggccgggagggcccccctgctgctgaggagggccccgcctcagccggtgaggacgtggacctgctctctgtggccgagatggtggccctggtggaacagcgggcagccctggccctgcagagctacccacgaccgaccaccccagcgcctgtagtctttgtgtccgccgagcaaggtggaccggccaagggggtgggatctgaacggcggtccggtggtggggactgcagccgtgtagccgaggccgtggcccactttgaagcgcagagggacagccctcccaccaagggcctccgcaaggaagagcggcccgggccaggccctggggaggtgcgcatcgccttccgcatctccaacggccgggagccccgtgcaccagacagcggcctgcccagtgggggcgggggcaggcctggttgtgcctaccctggcagcccaggtcctggggcccgagccaaggacaagatcacatgtgacttataccagctcatcagcccctcgcgggatgccctccccagcaacgtggagttcctgctggccagggcggatgaggccagtgagggtgacagcccggcacccgccaggcctgaggacactcccccggcgccccctccgccccctgcccgggactgcggagcgtcaggcttccacgtggacgtggtggtgacgggcgtggtagatgagtgcatcttctttggcaaggacggcaccaagaacgtgaaggaggagactgtgtgcctgacggtcagcccggaggaaccgccgcctccgggccagctcttctttctccagaaccgcgggccggacgggcccccggagccacccccggccgactccccggccactgcgcccggcccagacgatgccgagggcacggcggacacctccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggaggggaggtgaagccgggggaggggaggggagagcccaccacgcccacccctcccctctccccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgttttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatttataa

SEQ ID NO: 10608 - DNA, 1531 bp, Homo sapiens
tccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggaggggaggtgaagccgggggaggggaggggagagcccaccacgcccacccctcccctctcccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgtttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatt

SEQ ID NO: 10609 - DNA, 2302 bp, Homo sapiens
ggtagggctgcagctccggagcctacgggagtgtgaccctctcgcctcctggcgggaagctcttgaggagatattttcttttctaaacactaagaaatttgaggatggtggggcaaaacgactaactcccactttcctgtgactctgtagccggaaaaactgtcaaaatctgtggataaatttgtgagacaagaagaagaatggcatccagaataaatacaaatttcactttgattcccaaccagaaacttagacgtagtaatcgtcaaaccagctgttattccaagacccttggctcaggctttcaacccatatcaacatttggaaattttaaagccttaccattggaaatattccagataattttaaaatatttgtcagtgaaggatatcagcatgctaagcatggtgtccaaaacagtcagccaacacattattaattatatctcaacctcatcaggaagcaaaagacttttactacaggactttcataaccttgagctgcctgacaggagacaagactctgctatactggagcactacagatctctaggtctactgtttaaaagatgcacattgctgctacccaccaaggaaaggctaaaatacattcacaagatactcacagaagtttcctgctttaaattcaatggctgtgcagctcctatgcagtgtttaggattaacatgttatggcatgtttttacagaccttaacagcaggttgggatgaacttgagtgccatcgcgtttataatttcttatgcgaactgactaatctctgccgcaagatacaaatggctgtctgcagcaaaccaggaagtgcccaaaaactggagttaagaatcagactcttctgtaggaatgtcctccttgatcattggacacatcgaagtgattctgctttttggttgacgcgaatattaaaaccatggccaatggtgaatcaggcaagattactgtatatcatctttgggccaatatctcctcaagatggacaggtggtttggcaggaaatgatagaagaacctacagatgaattcagtctgaaaggtttggctgatgccattaagttactatatgacgctagcactaaagagtggacagcagatgatgttatcagtcttgtagatgaactatcagtggttccccgtgagtggcttctagagaataatgcacgtctcctaatgctaagtggaaacaacatctgtttcagtttcatggctagtaaagctgtgaatggacgcaccattgaactggcaaggctcgtagtctttttggctttggtgtgtgagaaagaactgtactgcatggattggacagttaaaatgatgcaaaaagtctgcaaagtctttagcactccagtggaaagaaagaacttcctgcagaatgtggcaaatgcatttgcatgtgttataatggaaatgctgcaatcaattatgtctggagaccgtgatgaagatgacagaagctttttgaatttgttccatcttgtacatgctcaggctaacttccataaggaggtcctgtatttgaccatgaatactcctctgtctacctaaatcctcagaaagccttgcctttagagaacgtcactgaacgaatgattagaggagtgctactttttcactcaaaaaatagcatccatgggactttttatcatctaagtaacctaagaattcaaaagctggatagaattttagaagcaactacgtacatcattattaatataaaaataacaggcagcctcaagaatgtgctgagatttctctggaaaacaagctctgcctctccgggttttagtcaacctaacaccaaaccaaaatagaatgttagctgttcaagaatctgggaccagccaacctgtatgtatgcatttttgaagcaagagaaaattccattttatagttagacccaaattcactaaatagtgtgtatgttcactttgtttaagttgtatagacatagcccagaatgttttgtgaagatttgcaatatggtgttttggaatgtgtagaatacaaatcacagtttttactaccttcttggcatatgcttacaaagaacattatattttgttcatgttttacatgaactaatggataaaaaacaaagtatacatatatgtctatatatatatatagacacacacacacagacatatatttccttctttaaggtaatcatacaaaaggtctatacatacaggaaggtatatattgtctcaatgcaatcaaatcatcttttactggggattcaaataaaatgtagcaaataagagaaaaataaaatgaaagaaaatagc

SEQ ID NO: 10610 - DNA, 2037 bp, Homo sapiens
gttgctcagctgcccccggagcggttcctccacctgaggcagactccacgtcggctggcatgagccggcgcccctgcagctgcgccctacggccaccccgctgctcctgcagcgccagccccagcgcagtgacagccgccgggcgccctcgaccctcggatagttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaa

SEQ ID NO: 10611 - DNA, 2221 bp, Homo sapiens
gtaaatcctagagaggcgggctaagctggactggggggagggtccgtcttccggaaagtctggattcccggacgagccgagttgctgctcaccgaactcccgttcgagagatgatcgaagaaagtcggctaccatttgtacccatcaaagatctccagatggaagccagcgctgaatttgggctgagattaggacttgcaggaggccggtccagaagacggcggaaggaatcttggcgggcgcacgcatgcgtgatagaccctccacacgtgtggccgggccgcggcctccccgtgctcggaggtcccgcccccggccgtagcatctttccggacgtggggagccggttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaa

SEQ ID NO: 10612 - DNA, 1520 bp, Homo sapiens
gcgcgttcgggagcttcggccctgcgtaggaggcgggtgcaggtgtgggtgctgagccgcccgccgcctggagggggagacagcttcaggacacgcaggccgcagcgagggcccgggccctggggatcccaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggcactgtggctcacgcctgtaatcccagcactttgggagaccgaggcaggtggatcacgaggtcaggagatagagaccatcctggccaacacggtgaaaccctgtctctactaaaaatacaaaaaattagccgggcgtggtggcgggcgcctgtagtcccagctactcgggaggctgatgcagaagaatggcgtgaacccggaaggcagagcttgcagtgagccgagatcacgccactgcactccagcctgggtgacagagcgagactctggctcataaaataataataataataaataaataaaaaataaatgttttcagtaaaa

SEQ ID NO: 10613 - DNA, 928 bp, Homo sapiens
ttaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgagtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggc

SEQ ID NO: 10614 - DNA, 2195 bp, Homo sapiens
cgcgctctcaggcagcgccgttgcgcgcggagtcatcgatcggccgaccccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 10615 - DNA, 1758 bp, Homo sapiens
ggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattaca

SEQ ID NO: 10616 - DNA, 1888 bp, Homo sapiens
ggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 10617 - DNA, 1650 bp, Homo sapiens
tcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccatggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctc

SEQ ID NO: 10618 - DNA, 2577 bp, Homo sapiens
gatttaaaagaatgaaaaggcggatctggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctggtaaa

SEQ ID NO: 10619 - DNA, 928 bp, Homo sapiens
ataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcagaccaagaaaaaacatgtttggtttcatttcgaagctccttagaaagaattctatagatcctctcaacatgataaagaagctttgaacaaaataaattcaaatttggaagaaaaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaa

SEQ ID NO: 10620 - DNA, 4559 bp, Homo sapiens
agagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgcgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaataggcatggtggtacacacctgtggtcccagctagttgggaggctaaggcaggaggatcacttagccaggaggctgaggctacagtgagccaagattgcaccactgtgctccagcctgggtgagaaagcgagaccctgtctcaaaaaagaaaaaaaagagaggttggccttttgtagcaatctgagaagtgtgtttttcaagttggaaaggaaggagaaaagcaacttgcctaagataaggtagctcttcatgatatgactgttatttctgatatacaaataaatagaacatgattaggacatagtcaaatatagctagaaaaatatattcctaaggaaagtgagatttgaggagtccctgttgttctgcaacatccctagattgaatgatctgttgcagatggtggataccaagttcaaatttaaagatttctttgtaagcagtaaagtgactttcacttatttaacttagaactggaaaaagtaacttttttccagattacattttctgtatatttgtaaaatgcaaaagcaatatatatttgttgtgagaaaattagaatatacagataaaataaaatttaaaaaaacacccaaagataaccagaagaaaatttttgctatgtaacctttttcttctggtctttgcaaatcctgccgtagaaactttttaacttcaggagtgtccttcctttgctctattaggacattacagaaaccaatactatgaaaagctgacagcagtatctggattaactttttaaaaacaatgaaagcattttacagaaattacatttcagatcgtgctggaactgtgttcagaagatatcctcagagggaatctggcctgagcaccatcatgtttaattgcctcctcctgtcttgcattttcctcccagcccccttcctaccccttagcagagggccaggtgagggtgcttggggcccatgggggctgggagtgtagacttcagttacacccccagcccccaggggaaagcattagccttgaatcctcaatcccaggccctctactaaccactctcaacctatggtatttatcttttgattattctgtgcatctataaaaatgggattatattgtacagaatgctttgtaagctttctctccccacataagaatgccctgtaagcattttgttaaatatttttaatgactttagagtccaactttatactcctctttacgcattttggttttctaatttaatggtagtgtaaacgtttttggaataaacattcctgtggctaaa

SEQ ID NO: 10621 - DNA, 3418 bp, Homo sapiens
gtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgcgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaatagg

SEQ ID NO: 10622 - DNA, 1580 bp, Homo sapiens
ctccagtctgtctgtgctctcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaaga

SEQ ID NO: 10623 - DNA, 451 bp, Homo sapiens
atacgtatgccatggaggtttgctgcacctattgacccgtcctatgagatccaactaagaagaacagaatacttgctatcttcagagtagaatattttgaaatgtatgtgtgctttacagtgtgcccagcattttaccatatactaactggttcaagtctgaaaggcacctctgctttgagtctgcttgccagagataagataggaggcaaggctaatttatattgtcattctgatactgtcagagcagatgatgatgaagaaaatgaaagtcctgctgaaacagatctgcaggcataactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaa

SEQ ID NO: 10624 - DNA, 569 bp, Homo sapiens
gaggagggtttgcaggacagccggggaaaatgtcccttctcggctcactgagtatattgaaccagtctcggtcctctcaagggattttatcagaagcattgagcatagattgaggcagaagctgaggaagattgtcattctgatactgtcagagcagatgatgatgaagaaaatgaaagtcctgctgaaacagatctgcaggcataactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctactt

SEQ ID NO: 10625 - DNA, 728 bp, Homo sapiens
agtgaataccacagaatagctggggcaggcaggcagcctgggccctcccacaacaatgccaagatgactgagtctcagaggatcacagaaagtccccctccatgcggtcagatcaggcctttggcctttggatgagatccaactaagaagaacagaatacttgctatcttcagagtagaatattttgaaatgtgcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcag

SEQ ID NO: 10626 - DNA, 3560 bp, Homo sapiens
ctcgggctccaggtcccggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 10627 - DNA, 1635 bp, Homo sapiens
gagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 10628 - DNA, 3702 bp, Homo sapiens
ctgctttcaaggtgtctagatacagagtgaagaatgtcacagtaggaagtgcactggactaggggagtcaggagacccgggttcttgtgttggcaccatcactcatgagctacgaggtgacttcaggctgccattggacctgtcaagtgcctgagtcatgtgataatgggctacattgcgcagggcccctgggccatctccacaggagatgccagaggacgagtgcccacttgctggtcttcacagagcacgctgaaatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 10629 - DNA, 3658 bp, Homo sapiens
acagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacactgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagatggagtctcaccatgttggccaggctggtctcgaactcccaacctcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagc

SEQ ID NO: 10630 - DNA, 2119 bp, Homo sapiens
ctcgggctccaggtcccggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggcaggtgcgcgccatggagcgcactgtggagaacatcgtactgccccggcatga

SEQ ID NO: 10631 - DNA, 608 bp, Homo sapiens
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 10632 - DNA, 537 bp, Homo sapiens
atggaccccaaacagaccaccctcctgtgtcttggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 10633 - DNA, 1483 bp, Homo sapiens
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccag

SEQ ID NO: 10634 - DNA, 828 bp, Homo sapiens
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 10635 - DNA, 754 bp, Homo sapiens
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 10636 - DNA, 762 bp, Homo sapiens
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 10637 - DNA, 830 bp, Homo sapiens
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 10638 - DNA, 609 bp, Homo sapiens
gcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 10639 - DNA, 1619 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctc

SEQ ID NO: 10640 - DNA, 1165 bp, Homo sapiens
agtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagta

SEQ ID NO: 10641 - DNA, 591 bp, Homo sapiens
cagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactggactc

SEQ ID NO: 10642 - DNA, 551 bp, Homo sapiens
acagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgatggagtctccctctatcaccaggctggagtgcagtggcatgatctgggctcactgcaacctctgcctcctgggttcaagagattctcgtgcttcaccctcccgagtagctaagactacaggcaccaccatgcccagctaattttttttgtatttttagtagagacagggtttcactatgttggtcttgatctcttgacctcgtgatctgctcgcctcagcctcctaaagtgctgggattacaggtgtgagccaccgagcctgacctggaagtaactcttttaaagataaagtgggaataaacttttatt

SEQ ID NO: 10643 - DNA, 787 bp, Homo sapiens
ctgctcctttggggtccagttgatgggcaagtgggttccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggttggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggtctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggg

SEQ ID NO: 10644 - DNA, 570 bp, Homo sapiens
atgtggttcttgacaactctgctcctttggggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcag

SEQ ID NO: 10645 - DNA, 1044 bp, Homo sapiens
tgcatgttacagatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccgtgagcactgcgtacaaacatccaaaagttcaacaacaccagaactgtgtgtctcatggtatataactcttaaagcaaataaatgaactgacttcaactggga

SEQ ID NO: 10646 - DNA, 2412 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaa

SEQ ID NO: 10647 - DNA, 1399 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtga

SEQ ID NO: 10648 - DNA, 1440 bp, Homo sapiens
tccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcata

SEQ ID NO: 10649 - DNA, 2115 bp, Homo sapiens
gccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaa

SEQ ID NO: 10650 - DNA, 2136 bp, Homo sapiens
agaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaac

SEQ ID NO: 10651 - DNA, 1472 bp, Homo sapiens
gccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattactttt

SEQ ID NO: 10652 - DNA, 2157 bp, Homo sapiens
agaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaac

SEQ ID NO: 10653 - DNA, 2100 bp, Homo sapiens
agaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaac

SEQ ID NO: 10654 - DNA, 847 bp, Homo sapiens
tgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggccccagactaaggacggcagcgaagcagagctccctcgttggtgcagaggttccctaagctcctgggcattcctaagaactgagctcccagctcttcaccgatggggatcattgtggctgtggtcactgggattgctgtagcggccattgttgctgctgtagtggccttgatctactgcaggaaaaagcggatttcag

SEQ ID NO: 10655 - DNA, 768 bp, Homo sapiens
atgggaatcctgtcattcttacctgtccttgccactgagagtgactgggctgactgcaagtccccccagccttggggtcatatgcttctgtggacagctgtgctattcctgggtgagtcagggcccccagcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagtttccacttgg

SEQ ID NO: 10656 - DNA, 2086 bp, Homo sapiens
cagatccagtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaag

SEQ ID NO: 10657 - DNA, 2310 bp, Homo sapiens
gattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaa

SEQ ID NO: 10658 - DNA, 1972 bp, Homo sapiens
tccctttagggctccggatatctttggtgacttgtccactccagtgtggcatcatgtggcagctgctcctcccaactgctctgctacttctagtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaa

SEQ ID NO: 10659 - DNA, 2167 bp, Homo sapiens
ggagccccggctcctaggctgacagaccagcccagatccagtggcccggaggggcctgagctaaatccgcaggacctgggtaacacgaggaagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatg

SEQ ID NO: 10660 - DNA, 462 bp, Homo sapiens
attgtgagagtaaccaacgtggggttacgggggagaatctggagagaagagaagaggttaacaaccctcccacttcctggccacccccctccaccttttctgggctccggatatctttggtgacttgtccactccagtgtggcatcatgtggcagctgctcctcccaactgctctgctacttctagtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcg

SEQ ID NO: 10661 - DNA, 2301 bp, Homo sapiens
gattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtccactccagtgtggcatcatgtggcagctgctcctcccaactgctctgctacttctagtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatg

SEQ ID NO: 10662 - DNA, 887 bp, Homo sapiens
tctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctc

SEQ ID NO: 10663 - DNA, 2289 bp, Homo sapiens
agatgctcagccgcagacctttgggagagtaaagggggcacacccacccaccttgcctccaggctctttccttcctattcctgttctatggtggggctccattgcgagacttcagattgagaaatcagatgaagtttcaagaaaaggaaactggcaggtgacagagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagagggaaaaaaagaaaataattattcctaaacaaatggataagtagaattaatggttgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagtcctctaatgctaggagtagaaaatggtcctaggaaggggactgaggattggggtgggggtggggtggaaaagaaagtacagaacaaaccctgtgtcactgtctcaagttaagctaagtgaacagaactatctcagcatcagaatgagaaagcctgagaagaaagaaccaaccagaagcacacaggaaggaaagcgcaggaggtgaaaatgctttcttggccggggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcatgtcagttccaatgaggtggggatggagaagacaattgttgcttatgaaagaaagctttagctgtctctgttttgtaagctttcagtgcaacatttcttggttccaataaagcattttacaagatcttgcatgctactcttagatagaagatggcaaaaccatggtaataaaatatgaatg

SEQ ID NO: 10664 - DNA, 2143 bp, Homo sapiens
aggctgacagaccagcccagatccagtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagagggaaaaaaagaaaataattattcctaaacaaatggataagtagaattaatggttgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagtcctctaatgctaggagtagaaaatggtcctaggaaggggactgaggattggggtgggggtggggtggaaaagaaagtacagaacaaaccctgtgtcactgtctcaagttaagctaagtgaacagaactatctcagcatcagaatgagaaagcctgagaagaaagaaccaaccagaagcacacaggaaggaaagcgcaggaggtgaaaatgctttcttggccggggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcatgtcagttccaatgaggtggggatggagaagacaattgttgcttatgaaagaaagctttagctgtctctgttttgtaagctttcagtgcaacatttcttggttccaataaagcattttacaagatcttgcatgctactcttagatagaagatggcaaaaccatggtaataaaatatgaatgataaaa

SEQ ID NO: 10665 - DNA, 1893 bp, Homo sapiens
gaaggatattaaagagcacctgcaggaattttttaaggggatgccgggggaagggcttgaaggaggaactaaggaggcttccagaagattttgattaacagcgagcgctagggaaggccacggggatacagaggggtaggaggaggatccagagacctccaagttgtggactccggaggcatcgagttcctttcccagttttgtcaagaattccctgagcggcagacaccctcaaagtaaaaaacgggaaccacagagaaggaaaaagaagaaccacaagcgttttgagaaacaaacaggctgggcctagggcctggggtgtgccctgcaactggggggtggggctggatgttcttggagtcagggagcagcagcctcccacaggatgtgagagaggaactggggtctccagtcacgggagccaggagccggccagggccgcaggcaggaagggagcgaggctgaagggaacgtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaatcagtgtgttctcatcatttttcaggcaggggaggtaagggaataagtcgggggactgaatggcggctgggcctcggatctctcctacaggtaac

SEQ ID NO: 10666 - DNA, 1731 bp, Homo sapiens
gtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 10667 - DNA, 1629 bp, Homo sapiens
agcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaatcagtgtgttctcatcatttttcaggcaggggaggtaagggaataagtcgggggactgaatggcggctgggcctcggatctctcctacaggtaac

SEQ ID NO: 10668 - DNA, 1351 bp, Homo sapiens
ctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaagggctgctggacaaagatagataccagctggggatgtgcacagatattcattccaagtgccacaaaggagaagttgagactcaaccagagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccat

SEQ ID NO: 10669 - DNA, 2605 bp, Homo sapiens
aaatggcaggggaattcctctcctgaattttgaattttccctgccctcctgcccaagttgttgcatcacttgtccgggagatgcctgaatgggctggtaagctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgaggtgagtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagatggatggagaggccacagtgaagcctggagaacaaaaggaagtggtgaggagaggaagagaagtggactactccaggctcattgctggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaagcaacgccagtttctaagcaacaatctcagggttccattggagaaacaactccagctgcaggcatgtggaccttgggaactccagctgcagatgtgtggatcttgggaactccagctgcagatgtgtggaccagcatggaggcagcatctggggaaggaagcgctgcaggggacctagatgctgccactggagacagaggtccccaagcaacactgagccagaccccggcagtaggaccctggggaccccctggcaaggagtcctccgtgaagcgtacttttccagaagatgaaagcagctctcggaccctggctcctgtctctaccatgctggccctgtttatgcttatggctctggttctattgcaaaggaagctctggagaaggaggacctctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcc

SEQ ID NO: 10670 - DNA, 2108 bp, Homo sapiens
agctggagggcaccagctgccagccaaatggcaggggaattcctctcctgaattttgaattttccctgccctcctgcccaagttgttgcatcacttgtccgggagatgcctgaatgggctggtaagctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgaggtgagtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagatggatggagaggccacagtgaagcctggagaacaaaaggtgcctttgtggacacatggatggccccctgatgacccatctccttcctttgctgcaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaagcaacgccagtttctaagcaacaatctcagggttccattggagaaacaactccagctgcaggcatgtggaccttgggaactccagctgcagatgtgtggatcaccagcatggaggcagcatctggggaaggaagcgctgcaggggacctagatgctgccactggagacagaggtccccaagcaacactgagccagaccccggcagtaggaccctggggaccccctggcaaggagtcctccgtgaagcgagcaacatgcccaggtttaagtactcttaaagaaatcaaagtcagtgctgtccttacccagaaccctcacagtctgctctgtgtctctgcagctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctga

SEQ ID NO: 10671 - DNA, 1898 bp, Homo sapiens
agctggagggcaccagctgccagccaaatggcaggggaattcctctcctgaattttgaattttccctgccctcctgcccaagttgttgcatcacttgtccgggagatgcctgaatgggctggtaagctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgagtctccaggtttaaaggagagcaactagaagtcgtccaaacacctgcatctcataaggagaagaaaagtccacctggatcttgtttctggactgagatggatggagaggccacagtgaagcctggagaacaaaaggaagtggtgaggagaggaagagaagtggactactccaggctcattgctggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcagtacttttccagaagatgaaagcagctctcggaccctggctcctgtctctaccatgctggccctgtttatgcttatggctctggttctattgcaaaggaagctctggagaaggaggacctctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcccattcacatgtattatatttaagtgtaccagccttgccttctcaagtagattctaagctcctttaaggcagtaattgcattttatctgtctcatgatgcccccagagaacttccaactcagtaggaccccaataaatacctgtgtctgattga

SEQ ID NO: 10672 - DNA, 1307 bp, Homo sapiens
cctggatcttgtttctggactgagatggatggagaggccacagtgaagcctggagaacaaaaggaagtggtgaggagaggaagagaagtggactactccaggctcattgctggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcagtacttttccagaagatgaaagcagctctcggaccctggctcctgtctctaccatgctggccctgtttatgcttatggctctggttctattgcaaaggaagctctggagaaggaggacctctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcc

SEQ ID NO: 10673 - DNA, 2778 bp, Homo sapiens
attctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacaggaagacgttcagccagggatccactcaggagccttcccagccctctaccccaagagttcacctacctcaactcacctaccccagggcagctacagcctatatatgaaaatgaaccaagagaacaatcagtggctgtgcatggcagacaacagcattcctcagagcagaaggctcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtc

SEQ ID NO: 10674 - DNA, 2596 bp, Homo sapiens
ctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaa

SEQ ID NO: 10675 - DNA, 1554 bp, Homo sapiens
gtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctc

SEQ ID NO: 10676 - DNA, 3118 bp, Homo sapiens
cgcgccgcagccgcggagggaggggcggggcgggctccggtgtcagcgaccaagccgcaggtggcggcgagcgcggggctcggcccgagctcaggagactggcaatgactctgtagctcaaacttgcctctctcttcagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 10677 - DNA, 3118 bp, Homo sapiens
cgcgccgcagccgcggagggaggggcggggcgggctccggtgtcagcgaccaagccgcaggtggcggcgagcgcggggctcggcccgagctcaggaggtgagtaatgactctgtagctcaaacttgcctctctcttcagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 10678 - DNA, 3117 bp, Homo sapiens
cagatggggaaactgaggcacggagctggacagtgactcagacaccaggagctgcctggagtggagctgagagctcaggtctgggctcagccagtccagagtgcaaatctactgtcccttcctagctgtgtgatcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 10679 - DNA, 3214 bp, Homo sapiens
cgcgccgcagccgcggagggaggggcggggcgggctccggtgtcagcgaccaagccgcaggtggcggcgagcgcggggctcggcccgagctcaggagatggggaaactgaggcacggagctggacagtgactcagacaccaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagctgcacccccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaa

SEQ ID NO: 10680 - DNA, 2907 bp, Homo sapiens
agtggcctcgtggctgtctcctggcgcctgccccgtcagacaggggccccatcccactcgctaccctgtccgatggggaaactgaggcacggagctggacagtgactcagacaccagggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctg

SEQ ID NO: 10681 - DNA, 3204 bp, Homo sapiens
acacaagcctccaacttggtgctgacggaagtggcctcgtggctgtctcctggcgcctgccccgtcagacaggggccccatcccactcgctaccctgtccgatggggaaactgaggcacggagctggacagtgactcagacaccaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaa

SEQ ID NO: 10682 - DNA, 3094 bp, Homo sapiens
gggcgggctccggtgtcagcgaccaagccgcaggtggcggcgagcgcggggctcggcccgagctcaggagatggggaaactgaggcacggagctggacagtgactcagacaccagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 10683 - DNA, 1278 bp, Homo sapiens
gcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtatggagtttcactgttgttgcccaggttggaatgcaatggcgcgatcttggcttactgcattctccacctcccaggttcaagcgattctcctcctacctcagcctcccaagtagctggaattacggcgcccaccaccacatctggctaattttttgtatttttagtagagacagggtttcaccatattggccaggctggtcgcgaactcctgacctcaggtgaaccacccgcctcagcttcccaaagtgctgggattacaggcctgagccacgcgcccggcctgatttaccttcttttaaaaataaaaaattaatatacaaagaatatgtaataaaca

SEQ ID NO: 10684 - DNA, 4980 bp, Homo sapiens
gccggtctctgggaagaaggcggcggcggcgaaaggcgggggtgctgtgggggccgggccgtgtttacacagcggcgggcgggcgcggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctgtaagtacaaacacaagacttaacagaaactttaacgatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttaactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttagcccaagtctgaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataattt

SEQ ID NO: 10685 - DNA, 4981 bp, Homo sapiens
gccggtctctgggaagaaggcggcggcggcgaaaggcgggggtgctgtgggggccgggccgtgtttacacagcggcgggcgggcgcggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagacacagtccagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttaactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttagcccaagtctgaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataattta

SEQ ID NO: 10686 - DNA, 2700 bp, Homo sapiens
acgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagacacagtccagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttca

SEQ ID NO: 10687 - DNA, 5939 bp, Homo sapiens
gccgcgcggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattgccttcaaagaaaaacctcggtatccaccaagtcaggctcaagcagctcttcaagacagtccccctgaagagtactcctataagaaatcaataagaaacctgtttaaaaacattccttttgtccttctgttgatcacttatggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaaacagactactctgatagtttatattttgtcttttattggaatggttatctttactttcacattggaccttagatatattatcatcgtgtttgttactggaggggtgcttggcttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaattaccatatgaactctaaatgcataattattattttgcttaattgttaaattaagggaaattttcttaaaattcttctgtttacatcatgttaacactactgtttatctaattagtatccggtttttagtctcatattgtatctgaaagtaagcttcttgacgtttactttttaaaagtcgatgtttttcttttttgtagaaaatggaagcttagaatactttttaaagtgataatatggggtgttcagtccccataagatataatagttcatgcagtttatatattaaagtatccagtggaactaaatgtacaatatattcctaattggctgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttagaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctactaaaaaaaaaaaaaaaaaaaaaaaaaaaaaaaaaggccaggcgcagtgctgtggctcatgcctgtaatctcagcactttgggaggccaaggcaggtggatcacaaagtcaggagttcaaaaccagcctggccaagatggtgaaaccccatctctactaaaaatacaaaaattagcgcagtggcaggcgcctgtaatcccagctactcaggaggctgaggcaggagaatcgcttgaatgcgaatggcagaggttgcagtgagcgaaaatcacactactgcactccagcctgggagataaagtgagactgtctcaaataaataaataaataaataaataaataaataaataaataaataaaacctgaggttgagcacgatggctcacacctatagtcccagcactttgggaggctgaggtgggtggatcatttgaggccaggagttgaagaccagtctggccaacatggcaaaaccccatctctactaaaaatacatacacacacacacacacacacaaattagccgggcatggtggcacacgcctgtagtcccagcttcttgggaagctgaggcatgagaattgcctgaacctggaaggcggaggctacagtgagctgagattgcgccactgcactccagcctgggtgacagagcgagactctgtttcaggaaaaaaagaacagaaatacctgagactgggtaatttataaataaaagaggtttaagtggctcacagttctgcaggctgtgtaagcatggcaccagtgtctgctcggcttctggggagccctcagggagctttactcatggtgaaaggctaagtgggagcagagatgtcacatggcgaagcaggagcaagagagcagggaggtgccacacaccttcaaacaaccagattttgtgaaaactcactcattactgcaaggacagcaccaagccatgagggatccacccgcaggacccaaacaccttctattagggccaaccttcaacattggggattacatttcaatgtgagattggagggacaagtatcccaactatatcaggcagaatatatgcattgatatatattgaaattataacattctctataatcaagtgactgtaaattatgtcgaatctgaccctggggaatgtgttatctaaagaatttgactaagaatcaggaactctgtgtccatgtcctggatgtatttctgtatgttcctataactctggacaaatcattaaacctctctgggcagcgttttcctcatccatgaaatgaatgtgttcaatttgatctcaaagatctttccaaaatattaaatgccattaatcatggaatagaccaaattattgtatcacaggaacttgaatccagccagagaaaaattccctggacaattggataaacaaatgtgattgctaccttatggatacaacggacttttacatttctttttagcctttttagtcagttgagggtaactcaagcagagtatgtccaatcattagcttcctttgatatttacattacaggtaaaaacggccaaaaatatattttaaggtctctccccaaatgtttttatttttaaactatcaatgttgtttaaaataatcatgtacttgttgagttcctgaggtttggaacaaattacacataaaatttagaatactttatttctgaaaagcatatacatatatgttatgtttatttttccttgttgattagaaaggtgatggaatatgtgacaatgcaaaatgaattgataatttttctgtattttgagtgaaagttgtctgtaatatgtcaagcaagaatgttataattctacagtaatgtgtgacttcatgacagagctacattctgagaaatttgtcattaggtgatttcatcattgtgtgaacatcatgaagtgtacttacacaaacctaggtggtagagcctactgcacacctgggctagatggcaaagtctgtcgcttctgggctacagacctgtacagcatggtactgtattgaatactgtaggcaactgtaacacaatggtatctgtgtaatctaaacatagaacagataatacattgtgctacaatgtaacaatggctgtggcatcactaggtgataggaatttttcagttccattataatcttataggatctctgtcatatgtggtcaattgttgatcgaaacatgactgtatgtcgtattttcagaaaatggaataggtaatcatcacttgtgtgaattttaatcaaatgacttaggaaagaaactggatgtttcaaaagctgttgcatttattacaaatgtcacaaatacagctcttgccttttgagaatgttggagagatgtctttaaaaaatatgtttgtgtgtaaaaatgtgtctgtatgcaatagctagaaaaatgcctgtgtcttaagtcattactcatgttctaatttttgttctttgtactatttatctgtatgcttgttcttcagtatttcagactcaaaataaatttatttttttatgttaa

SEQ ID NO: 10688 - DNA, 12119 bp, Homo sapiens
gtcacaccctcgaataatgacgcatacctatcctactgttactgatcacctagtaataatcttgtagttcacattactcatttttcaccaaattcttttggtgaaggacgcttcagaaacggccatcactgaagagcagacccgtttgggttctccacgcattctagactcccgaagagctcatgttttttggctagacctatgaccattttcgctagacttcactgcacgttttctcaagtatcttctttgtccctaatgtgtgacacctcatcatggacacgctactttagctaaggcatgaccagcaatgaacagtagtaagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagtcttggctacttatgattcagcagacagaacaacttagtaggataatgaagacacatgcagaggacttgaactctggacctttacacaggctcaccatgatgattaaggacaagcagcaggtgaagaaaagttacataggtgttcatcagcagatagaggcagagatgatcaaggttaccaaaacagaattggagaagttaaaatgcagctatagacaattaataaaagaaatgaattctgccaaagagaaatataaagaagctttagctaaagggaaggaaactgaaaaggccaaggaacgatacgacaaagccacaatgaaacttcatatgttgcacaatcagtatgtattggcgttgaaaggggcacagctccatcagaatcagtattatgatatcacacttcccctgcttctggactccttacaaaagatgcaagaagaaatgataaaagcactcaaaggtatatttgatgaatacagccagataaccagtcttgtcacagaggaaatagtgaatgtccataaagagattcaaatgtcggttgaacagatagatcctagtacagaatacaataatttcatagatgttcacagaacaacggctgctaaagaacaagaaatagagtttgatacttccttactggaagaaaatgaaaatcttcaggcaaatgagatcatgtggaataacttaacagcagaaagtttgcaagtaatgttgaaaacgttagcggaagaacttatgcaaacacagcagatgcttttaaacaaggaggaggctgttttggagttagagaagagaattgaagaatcttctgaaacttgtgagaagaagtctgatattgtgcttctgctaagccaaaaacaggcacttgaagaactgaaacagtcagtccagcagctgagatgcactgaagcaaagttttcagcacagaaggaattactagagcaaaaagtgcaagaaaatgatgggaaagagccacctccagtagtaaattatgaagaagatgcacgatcagttacatctatggaaagaaaggagaggctatccaaatttgaatctattcgtcattcaattgctggaataattaggtctccaaaatctgcactgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttcgacagtcttctaccattattttttattaactgggtgttttaaaagtacgttccacttgtaaaaagtcaaaggcaaatttgttaaagaaataggcagtcctaccaagggctttcttagctaaccatagcaatcctaccatttcaggccattgcaaatagaaaagcacaggcttctaagtgtgtgaaggataaaagatctatcctatccttttcacaccttgtttctacttcaggcacagtttgtaggctgccatcctatgccacagaccctactccgttggtgctataaacagcattggtaatgccatgtttgcaggacatgttccaaccacagctggctttcacctctgccaaagcaggattatatttgtaaacaaacaaacagaattttatattgggaattatttggacctcctgagatttttcttttctttcttgccaggtataagcccaatgtaagaatcatcatgctcctacattatttgtaaggttgtcattttcctcctcctttgtctgggcatcagaaaacaatgcacgtaggtcgggcacggtggctcacgcctgtaatcccaggcatgtaatctcatgcctgggattacaggcgtgagccacagtgcccagccccctccctcctttgggaggctgaggcaggcggatcacctgaggtcaggagttcgagaccagcctggcttgcatggtgaaaccctgtctctaccaaaaaaaaaaaaagaaacacacacacaacgcatgaaacgtcgtcaaagttagagttgaggcagttgcttttcaaggatgtacagagagctgtgaagcaagaaacagatttgaacaggagggtgggctggagaacagagcagctaaagaatgattaacagagtaaagaagaaagtgaaaatataaaaccaccttatcagagttatgcctttctaaacatctaaacaaacaaacattcacatattctattctaaaaacacataataatacatattctattttatggtctgaatttaccagaaaggtcctaagaaaagtttcaggagttcgtagagtcctcgtaatggcaacaaaaattttgagagaaactgcaaagcacaaatccacagaaataacagcatactttcagttaagcattttcaccttagagggggcattccaaaatgtaatttcctttatttgtaccagtttttagagctgtcagaatttcatgattctagttcaccaacacattcacgtgtgtacatgcgcgtgcacacacaccaccaaggtgcaagacagatgtgaatgaagtagacagtctagaagtcaggtgaatattaatgagaaatatgacatagggacagccctcccatttctacttccaccttcattgaccattatactgccccctggacattcttaccattagctgacaggtatgcaagcagagtgctgaagatgtctcatgtgaataaaatgtaactcactcactcagttaaaactaggattctgtatcttaactcttatctagggaacttacttacttaccccatgatctgtatatagttgcctctcaggataaatgcatatatagaagatggtcatgctcagggctaaatatgttctggaagccttttataagttctcaggcctgtgtcctggtaaacattaccttagtgattatttggtctgcattcattggaagagcttagggatagaaaatgcctcctgccctctccagctgtttgctgcctgtaccatcgcacagaactcacaccagtactttagagtatgaaagataatactgaagagaaaagtgacttgtatctaacatttcaatctccttgcagatttcatacatacttaatgattagtacattcagactaaagggaaatttcttttgatggcacgtactatggtaaatcaaagcgcaaactcagaagtgctatggtattgaggcacttaccaaccttcaaaagtaagagtaaaatgggatattcctacccttttttttagtatttctaagtgaatctctgtaatattctttgtctgtttaaagaaaacagcctcccatctcatagtggcttcatgctaagctctcagcaaggagagagaatgatggttttggctttagttttatgaacaagacctaaagcttaatcctgacattctggtgttaagaatgaacacagcattgatatttcacttatccaggctgttagaatttgcagttcacatcattactctgtgcttaaatttaaaaagcttttcaaaacatcgtgacatgtgtagcatttaaattccattttattctttgtcctaaagcaggcagtggtatagttcaggattaataacttattgggagtctctcagtcatatagaatattaaatttaatatagtcacatgcattaagaaaaacttacgcaaacagtttttcactgttaattttgttgtgcttgaagcataatttattcatcccttctgtcactgataattaattattggaattatatactttaggaggctaatccatgcccaggaagcacgaacatactgttcagaatgtgcaagttgatgtagggaaaggaagattcagaaatgtacaaaatcctgtgatttgtttagtaagaaaagagttgtaaccaaaatttcttctggtccggatgtaattagtccagtcacaaatctttgtgttgttaatggattattcaagatatatatatatattcttactactgcatagttcctctcataagtccttaaatttattaaaagggggaggtaaacacaagcagtctgtgtctcactggtcactaaggggcctttatgagacagtttaggttgttcatcatttcacaaggaaagaaatttttcactgttaaattaacatttattaccaacatgtgaaacctaaaattaattttgcattccatgtaatctaaggccaaagccaacatattctttctcttctgggaaaataaaattgacaggttttgtttaaacttcagaaactgaagctttatttcagcctgtcctgccatgaggtctccagtgagaggtctccagtgaaaggtctcatgtaattgtttctcttttatctcccaaatttaatgtgggcaataaaattctcctttcgtaattcactgttttattacaaatacgatattactgaaacatcttattagcagataagtatagaccaggagcctaactgtgttagatattttcagtgcacatttcacagttgtttttcattttaggattattttgagaagaaaaaatgttttgtaattgaaatagttttaatttcctttaaaccataatttggtttttctatctatattatattcagttcagttttcccatataacttttgtgaagattggctagtaccacaaaataactatggcttcacaatactagtgttagattatgtcaagaagaaagtgttttagttacaacatacgccacccactgaggaccttgtagtgggataaacaaaaattaaaatgcaacaatccaaataaattataatgtaacaatacaaatatctgaatcataagtcacagtttttcagggttctttcagtcacaccactttataattaattctggtgagtcatcagatgtaggaatgtacctgaaaaccttacttagtatactgtgtacactgtttaatggccatgcatcttttgaagtttgatattttctgaaaaagcattgtttgcctcagccctcttctttttacgtatactccatttatcattgatattttagatgtttcttatcaacaaaattggctgccctggttagtgctgagtcatcgcaagacttgcttttgcatttaggaagccacaccctcccacaaaacagaacagtgcaaaataagcagcagagagacagacagttggaaaagacatgttttctttaggtattaatatcttaattaaatggaatcagattttgtatggaaatgagtttatattacatttccattatactaagtcagtgtgaaagtttaccatcaaaatagcgttacttcttttatgactaactctgatttgcttatacatatcagaatgatattcattaaatattttaatttcatttatttttctatgttttgattagtttcacatcaagtctgaatactatattttggaagaatccaaaaccacatatgaagatactgattttaaaagtcaggatttcatgtaccaagaatgacctacttgaaggagattttgctacactcttagagtcccaaaaattcccctttaaaaaaaatgctgtcctacagaaggtgtataaactataccttagccataattcaatttaatgaaatactaccccattaaaagccatcctcctgcctcataccgattcagaaattaaattctgaacttttagtgtaggcattaggaatcacttagccacttaataaggactgagattcttgggtggcagaaaaatcctggtgtgctagattcttagtcactttaaactgcatagaagtaatgagcataggcttcagtatatttaataaggtgctgaggcagcagattcaaatgcaaaagagggaggaaccagttattccaaggcaggatgatgcacccccacacagagtgtggaaaaattaaagtgaaacaaagatttggacagtgtcattaggaagcctgaggagaacatgctacaaggccagatcctgtcctatggaaaataaaaaagatcagcagaactaaagcaaaagcagtcatctccagtgtgtgggccttagcaaagagtaaaccaaatacctctccttgtgttaggagcactgttatattcccagctcagagatgattgtgtgctgggaaatgcttatattcattatttcccaactaatgcatttggacatatgtattccagtttttcaaagacactacccaaagcttctttacatttgcattggttatatttaatatttcttaagctaagatcactgattatccacacgttattagaaatctttggttacagtgaggcttaacctgggctaaagtctcctaaatgggactacacttagatccgccctatttcacctttggactaacgttgactaaatggctcctagagttacccacagagggagcttactatgatgagagctactgtggggaaacatagtattcaacagagaaatggaagaatacaagtagcaatgttccttgtcttcaataacatttgagggaaaggaatctagaaatcctaaagcttagtcagggtgcctaaggtaagacacaaaaagaaagagacatccagaaaggaaggttgaaaggaaatgaagggcagtaacaaagcaccaatgtaaaatgacccatagccaacaataaatgcaataacaataaaggaaactaaccctcacaaagggtttgaggagcttcctgctgtgtgtccttaaacagtgcgtgcctcttaagtctctacaacacttttttaaagggcattgaattggacattggtttaatttttacctacgctccctataatctcaggaggtaaccattatttaatcagaattacccttgctctgtttatctgtgaggcctcagacacaacggtggttcagccctctccctaagcagtagcaagctgagtaatggcacacatatgtctaggatagccagcattcaggaaaattgctgtgaacctcctgtttttaattttaatatagaaaaagtctttcaggtttgtgacacgaagacagatttagcttcccacttgtcagcaaatttgtaaaaacctcaaaacaaatgaatatttggaattcactctaagagatacaaatcctgaatttctaactatcttctcaaatattactgaggccagcaagatgcaagtgttctacaaaataatgaactgttctaagtgacagtgttgatgctggaagtggaatgttatgttttcgctcagctgtattcattcagaaagtttttcttgaacatctgccacatgaggtgcagagaatactaccaggtgctagtttttccagtatttgacttctgattactatttccttttctcatctttagtttttcaagattttgctttaccaaaatagtaaagcctttatcatcagcttatattgaataatgttgtaattggtttcaatcaaagtttctcctcaggtacttgggggcccctagccttctaaggaactcccaggcacctacttaacaaggccagctacacactcagtatgtgataagccccatgatggatgcaggttagaattcaaagacctggttggagtcctagatgtggagacaggatgatcaggtcacacttgttagatgactaacactatcagtagaagctcttgagagattttcctaacgcagcaagatttctgtgagtagaggtatcctgggaggtatcctgggaggcagcctattgacttgaccaagtaagctgatcaggtggcctcctctacccactaaagaaatgtgtaaacactagcaataattgctttatcttaaactcctggacatactcagttcttccattccactgttctattgccaataccttttgttgttttcttcacactcctcttggcagcaaatgtctgaaagtatttcaattgtgtaatgttaaggagttttttcatagcttcagaaaagagggcagcaaatatgaagccttaagttcaaaataagtcattctacctagaaatacagaccccagagcacattgcatgaaaatacctgtactctgcagttcctcaaagcagtattcttcctgaaaagccaaacaccacacctattttcctatttgctaagaatcagaataagcacgttgtaaatagtatccaaagcagattctaaaatgacatagtaagaagccagattcaaattgtaaccaaagaagacaatagaaatcccactttaccccactgtcatcagttagaacacccttgcaaaaactgtaaccacttaagcaattcatctgatcccagaagatcataccttcttttgaaagtataggacagatatcagtgggaaacgtcggcgttctgagcaacacaggataaatgtaggagggccttaaaaaataaatctcaattcatacactggagcagcaaaaaactgagcaggaaaggaaacagaatccaaagtcatttttcatatagctgttgtcaaatagtataaccttggtgtcttctttgagttgcctggacagtatttatgaaacaaaaaactaaatgccccccatttggggacggggggaggggttcagacctctaacctggattcagagccttagaggccgagagggaatctggaatctggtattactgagatcctaggtaaaagaaccagcctggcagtctttcccacctcattggtccgtgcttttatttttaaacccaaaagaaagaaagaaacacaccctcttatgtaggaatttcccttttacaaataatttgacctggtagaaataaacttgcctgcctgctcttaaatgccagacagttggaagcaaatgccgagggaaaggtgcccagagccatgcttgataggactttgaatattttctccttaattaaagtacgttgcttgtatttagactataagatgctatggaggtctatcccatgccatgccaatgtgaattgctttgcttcagtaacaatcagaagaccagtccaacagaaaataacttgtcataattccaccttagattctagacctctcatacctgcagtgtacagaatatgtacatgttccaatggaattcactatttttggctttagtgtcaaagagattggttctacaaggttcatctgatttcccataacaagtaaattttataatcctatgattctaaattcaatccccaatatagattctaagcatcaaatcaaaatcacagacaaaggggaactggtcgagaggggtcttagttatttcaaatccatgaccaaagtgtccaaagacatgaaactcttatacctgctgagcatttcactttactatacaaaatgtcagctacccagttgcatcctgtgacatgatcagactgtcaatgtggaccagtggccaggagcatatttatgggccatttctgttcatcattctttacagagcattgaggtttcccactgaaacagcttctttagtcagacgtctatagattttacataaatttacatttaaatgcattaagttagatggcccaattgagcatctgaatgaatatagtgggggttggtggtggtgcaaattctgctggctttatgttatggttttcttcgtgttttttcttggttttgtctggcttcttctggcaagtgccctaaaagactggaacactgtataaagtcatagacatagaaccatatgggaaagcccagatgaaaaaatggaagaataaaatcaagttgtcaaagttccagcaacagccctgacttcttcaggaatccaagcaaattgaaagccaagacaaaatgtacaaatggtgcccatgccattcatttgactgtgggtggccctctagtctagggctctcttagtgaatggttgtggaaatatgatttttctaagttccttccttttccttttgatagatgagtttgagatgatggagtaggagtggggccctcaggcacttctggtaaagacattccacctgcaagcagcattttgagtaaagcactgctgtggtttgccgatttatggtccatttaatgttaggctaaagcacctttaatcatttttgttgttttaagataatgtatttgtgaagtggataaacactggaaatagggtgcttcttctggaaagttcagtgtaaaacacaaacaaggctttggcgggtttatctggctttataaacaagtctgaaaaatggatgaaagctaaatatataaagcagttggttgtctatcttttatcatttttactcagatctgtatttaacacttatttatttgttagtttttacattcaaaagaaatacactttgaactttggctaacattgtaggatattttttaattgtttctacatttttaaagcatgattcatcatttttgtaaacttagatcattttttaattgtcttttcttttccaatagaccagttaccactcatgtgtctgcagaacctctttattgtattcctataataaatgtaaaatatttgtagcaaa

SEQ ID NO: 10689 - DNA, 2922 bp, Homo sapiens
acatacacagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagggaaggaaactgaaaaggccaaggaacgatacgacaaagccacaatgaaacttcatatgttgcacaatcagtatgtattggcgttgaaaggggcacagctccatcagaatcagtattatgatatcacacttcccctgcttctggactccttacaaaagatgcaagaagaaatgataaaagcactcaaaggtatatttgatgaatacagccagataaccagtcttgtcacagaggaaatagtgaatgtccataaagagattcaaatgtcggttgaacagatagatcctagtacagaatacaataatttcatagatgttcacagaacaacggctgctaaagaacaagaaatagagtttgatacttccttactggaagaaaatgaaaatcttcaggcaaatgagatcatgtggaataacttaacagcagaaagtttgcaagtaatgttgaaaacgttagcggaagaacttatgcaaacacagcagatgcttttaaacaaggaggaggctgttttggagttagagaagagaattgaagaatcttctgaaacttgtgagaagaagtctgatattgtgcttctgctaagccaaaaacaggcacttgaagaactgaaacagtcagtccagcagctgagatgcactgaagcaaagttttcagcacagaaggaattactagagcaaaaagtgcaagaaaatgatgggaaagagccacctccagtagtaaattatgaagaagatgcacgatcagttacatctatggaaagaaaggagaggctatccaaatttgaatctattcgtcattcaattgctggaataattaggtctccaaaatctgcactgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttcgacagtcttctaccattattttttattaactgggtgttttaaaagtacgttccacttgtaaaaagtcaaaggcaaatttgttaaagaaataggcagtcctaccaagggctttcttagctaaccatagcaatcctaccatttcaggccattgcaaatagaaaagcacaggcttctaagtgtgtgaaggataaaagatctatcctatccttttcacaccttgtttctacttcaggcacagtttgtaggctgccatcctatgccacagaccctactccgttggtgctataaacagcattggtaatgccatgtttgcaggacatgttccaaccacagctggctttcacctctgccaaagcaggattatatttgtaaacaaacaaacagaattttatattgggaattatttggacctcctgagatttttcttttctttcttgccaggtataagcccaatgtaagaatcatcatgctcctacattatttgtaaggttgtcattttcctcctcctttgtctgggcatcagaaaacaatgcacgtaggtcgggcacggtggctcacgcc

SEQ ID NO: 10690 - DNA, 1486 bp, Homo sapiens
gtcacaccctcgaataatgacgcatacctatcctactgttactgatcacctagtaataatcttgtagttcacattactcatttttcaccaaattcttttggtgaaggacgcttcagaaacggccatcactgaagagcagacccgtttgggttctccacgcattctagactcccgaagagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagtcttggctacttatgattcagcagacagaacaacttagtaggataatgaagacacatgcagaggacttgaactctggacctttacacaggctcaccatgatgattaaggacaagcagcaggtgaagaaaagttacataggtgttcatcagcagatagaggcagagatgatcaaggttaccaaaacagaattggagaagttaaaatgcagctatagacaattaataaaagaaatgaattctgccaaagagaaatataaagaagctttagctaaagggaaggaaactgaaaaggccaaggaacgatacgacaaagccacaatgaaacttcatatgttgcacaatcagtatgtattggcgttgaaaggggcacagctccatcagaatcagtattatgatatcacacttcccctgcttctggactccttacaaaagatgcaagaagaaatgataaaagcactcaaaggtatatttgatgaatacagccagataaccagtcttgtcacagaggaaatagtgaatgtccataaagagattcaaatgtcggttgaacagatagatcctagtacagaatacaataatttcatagatgttcacagaacaacggctgctaaagaacaagaaatagagtttgatacttccttactggaagaaaatgaaaatcttcaggcaaatgagatcatgtggaataacttaacagcagaaagtttgcaagtaatgaaagaaaggagaggctatccaaatttgaatctattcgtcattcaattgctggaataattaggtctccaaaatctgcactgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctgaacatgtatcgattcgagggcactgggttttcaaacattcctcaacttatagatcatcactatacaacaaaacaggtcatcactaagaaatca

SEQ ID NO: 10691 - DNA, 4665 bp, Homo sapiens
gagtacgggcccggacatgttcctggacattgcagaggccctgtcacatgcatgtctttattgtaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcc

SEQ ID NO: 10692 - DNA, 4997 bp, Homo sapiens
gagctcttcctggctctctcacgggtcactggctttgaggacgcaggctgctggggtggcagtgcctgctaacaggccagagactgcgcaggacccagggaatgagagtggtggcaggaaagggaaggggccttgttgactcactcgctgggcagcaagtgcttagtgacaagcagtaaacaaagacagcggcaacagtgctggtggcagggagctccgcggacagacttgcaagagacccctgctccttgttggaaagttgtcccatgatgaaggcctagacctggtcacggagacttttggatgcagcctttaacgaaggacgcaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagatgcatgtctattctttaggaatgaccctctactggtcagcagggtttcatgttccgccacatcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggagcaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcca

SEQ ID NO: 10693 - DNA, 4955 bp, Homo sapiens
attgccttcagtggcacctaatccacttgagctcttcctggctctctcacgggtcactggctttgaggacgcaggctgctggggtggcagtgcctgctaacaggccagagactgcgcaggacccagggaatgagagtggtggcaggaaagggaaggggccttgttgactcactcgctgggcagcaagtgcttagtgacaagcagtaaacaaagacagcggcaacagtgctggtggcagggagctccgcggacagacttgcaagagacccctgctccttgttggaaagttgtcccatgatgaaggcctagacctggtcacggagacttttggatgcagcctttaacgaaggacgcaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcc

SEQ ID NO: 10694 - DNA, 1959 bp, Homo sapiens
agttgctgagcacccgccttgtaccagtgcttgggctggggacatgcccagatctctcacatagttgctattgttaagcttatgaacacctaatcttattgctcagtggagaatacaatctaaacgaacaggtgaatacagaagacagtgccagtcggagggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcca

SEQ ID NO: 10695 - DNA, 7917 bp, Homo sapiens
ttttccagccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatg

SEQ ID NO: 10696 - DNA, 8465 bp, Homo sapiens
gggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgagccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatgaataaataa

SEQ ID NO: 10697 - DNA, 3939 bp, Homo sapiens
aagtcacattctccccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacaggt

SEQ ID NO: 10698 - DNA, 5297 bp, Homo sapiens
gaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttctgtttttttaaaaatatttttatgtgttcaaactattttggtaaatttttagcaaaaaaaaaaaagaagcctcctggagttatttacatgtacagattgtaagactaatgcacaaaaggtatatcagaatttttttaatgttttggcgctactttgtttttaaaaatatttttggctgaacaataccataatttgttatgatctgcataggagatagaaaatgggtagaaagacactatagtaagtaagctgctaaaacagaggatggaactggaggatgtagaaactgagagcatcaagtggactcagggtggtccatttttcaaagtatttggacaagaggacttgttattttcatttgtattctgtccgtatattttggctggagaagcagatgttttaaaaagaaagtgagagtttaaaggaaaaaaggtaacagatgtgctagtcagttgcatatcaatgtacattaacccaagagtgaaggcagataggaactggagaaatggaaagtggcaaaaatgagttctggtgaggctggcaggcaaatggtgacaggcgaatggtctattttatgaaagtgatggtgatgccagcgttcgatgatgtgaagagcagtgcagtcgctgtctgagttaacatgaacatgtttaagtggatctaaataaaagtggagaaactttaaggtaaatattttgatccctcatgccatttgttgtgattctgtagaagaaacttcaaaaatgtgtttgtatgtgagtgtgcgtgtgtgtgtgtgtgagagagagagagagagagagagagagaatatgaatggctttttgatacatgtccatgatcatgttttgcggtggtcattatactcctttcctttcccagttgttttaaaatttgacttccatagagaaactggagaggcctcatgagatgacataccagttcagcctgggtaaagtagtgacatgaccctaaccagactgtagaggggaccagtgctctagtaccttccttgataccattaaatccatgatggaaaggatttaatccaacaatttaatggtatcaaggaaggtactagagcattgtaccatcagcaacgtactgatgccttcccatgcagactacctgctgatactgtgttatgtgggagaaagataagagtctagaacttatgccatggagcatagagcttctctgtggattgaaaacattccactgccctaatgtacaaagttacagggcccacttggaatcgctctctctagctaatgacattccaaccctatcattagcatgatttctaaattgggcaatacatttccactcactcagtggagctctgagtacttcactggacatttaattttggaaatgagttttgaaactcagttcgtgaagcctgcagtcgagcaaatgactatatatttgccattaagtttgaggggtttcctttcctatatgctttcagtgatttattttgctttttaaataaagattgtttgtttattacctgaaagttgatactgatttaggaatatattttctgtgattggaatcctcaacaatttattttggaagcttgcagatggctaggtttgaaattgaaatttgtgtttttctccttcttttctcatacgacttctaagtcatcctttctgacataaggcaactttagtgtagtctgcacaaaattagtccccttctgatcatgcgtcatataattttctctaaagttctgactatgacaaatcatctggccctcagtctttcaaaataatattatataatattttttaaattatggaactaatatattttccattgtaaaatacttaaaaaatatgatagtataaatatcacatgtaatccaacgatgcagatttatcttaaggagtaataaatatattattttaacatttccagctaacatctcttttctcttaggtggaaacttcattgttgaatagaaatgtttttaagtgaagaagttgacagaatagggtctgctgaatttaaacagccatcaaaagttaaactggaatcttgaaatgccatttgctcggcatagaatcagagccttttagaaacatccatttaagttttgttagaagatagtcaccagttgcctgaatcgaatgaggaaaagcctgcttccagagatggacagtatattatagagtgagatatagagtttaaagcaagtgtgtgagtatatgtatattccatattattggtatatgtgtgtttatatatgaatctgtatatatgtgtgtctttgaatagacacaacatatatgcccctcatgcataattgtgcttattttgccctaattgaggaatttgagatgtattattggttcttctccctctcagatactatggtgggtaaaacccacagcctgaaagggttaaattttccataaatgccactgagtgtacatttgtggatataaataaatatatataatacacacacacatatggcaaatacatatacacacacaatattgcctttagtgctaatgcaagttggatcatgaaaacaatgtaggtaaagtaaagtatgtatttgtctgtgcttgaaaaatattgtaaaatgttatgtatttggaatatattttgtggtttgtctaatatttataaacacaactcggggtgaattcacaatgagtttatttcattgaaatactagagatatgggggccatgttactgtgattggagccttacctttgtatagtgaaatttgcatttctatgtcaacatccagattgttttatatgttaatatggtggcaggaatccctaataaaaatactctggggtaaaa

SEQ ID NO: 10699 - DNA, 964 bp, Homo sapiens
tgagttatttctgttggccgcattaggaacctgacatttgattcattcagtgggtcctgcctaggtcctttaaaacagaatggactgttagggaaaggctgccctgggccatgcaggccgaggagaccaaggggattggaataaccagtatggcaaaatgcttggtcaagatccagactcgacgaagcctccaattgcacatggtgaaccactgcaacagtaatgtgtttgttcgtctgctgagactcggctccaaggtcacagctcgtaacactggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 10700 - DNA, 1323 bp, Homo sapiens
gaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagatgtgtacagaagaaaatttgttcctgctttggggtgacttggtga

SEQ ID NO: 10701 - DNA, 1397 bp, Homo sapiens
gcttcatttcggaagtgattcatagcacttctgcttacaactctctgatcaggactcatcccaagatcttacccaggatcaaggaaatgcaattctatggtgttcagaagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 10702 - DNA, 2198 bp, Homo sapiens
cgcgagcccgccgggggtctcaggctctgggcgtcctcggcgagcgagcccgggcagagggaggcgcacgagcgcgcgcgacagaaggaggcggggaaaggagggggcgaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 10703 - DNA, 662 bp, Homo sapiens
ggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagatgtgtacagaagaaaatttgttcctgctttggggtgacttggtgaggagctgtaatgtgaaagtctgcaaaaccaggctatcacactgtaagaagcagaagactacaggatgagagaagctggagaatcttggctccaggcatgttggtgcagatcctgaaagtgcagcctgcccaccaatgagaaaagtctttatggttccctcctcttccccaaattgtacttattcaatgcagcagaaatgaagaggaaatgataaaacatatcattcatctgtttcagaa

SEQ ID NO: 10704 - DNA, 3198 bp, Homo sapiens
aaatgcccttgggtgtgcattacttcaagcaaacggaagtgtgccccgctgacagtgggaatgcctggctgggggtgggggggcccgagtgcaccacatccagctgggagtgaaattcctggagaaagcacccacagcactctgagcctgcttgcagcccaacggcctcgctgagaatgctacatttaaaagtgcagtttttggatgattcccagaagatttttgtggttgatcaaaagtcatccgggaaggcattgtttaacctgagttgcagccatctaaatcttgctgaaaaggaatattttggattagaattctgcagccattctggaaataatgtttggctggagcttttgaagcccataacaaagcaggtaaaaaatcctaaggagattgttttcaaatttatggtgaaatttttcccagtggaccctggacatctgcgggaagaacttacaaggtatctttttactcttcaaataaagaaggatttggctctaggaaggcttccatgcagtgacaactgtacagcgttgatggtatctcacatcttacaatcagaacttggagactttcatgaagaaacagataggaagcatctggcacaaactcggtacttaccaaaccaagactgtttagagggcaagatcatgcactttcatcagaagcacattggcaggagcccagctgaatctgacattctgctactggacatagcaaggaagctggatatgtatggcatcaggcctcaccccgccagtgatggtgaagggatgcagattcacctggctgttgctcacatgggagtactggtgttacggggaaatacaaagatcaatacttttaactgggctaaaatccgcaagttgagttttaagagaaagcattttctcatcaaacttcatgccaatatcttggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctatagtggacgaacccaaaggcaacttttggaatatgggagaaaagggaggctgaagagcttgccatttgaaaggaaacattacccatctcagtaccatgaacgacagtgcaggtcctcaccagacctcctctctgatgtgtcaaaacaagtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaattat

SEQ ID NO: 10705 - DNA, 2864 bp, Homo sapiens
aaaaggcatctgactgactgggggcaccattcctttcttgaatcatcttggatctgggagaaggaaaatgcttctttcttatttctgtttctttctcaagagattctccccaatttctttgcaggtatctttttactcttcaaataaagaaggatttggctctaggaaggcttccatgcagtgacaactgtacagcgttgatggtatctcacatcttacaatcagaacttggagactttcatgaagaaacagataggaagcatctggcacaaactcggtacttaccaaaccaagactgtttagagggcaagatcatgcactttcatcagaagcacattggcaggagcccagctgaatctgacattctgctactggacatagcaaggaagctggatatgtatggcatcaggcctcaccccgccagtgatggtgaagggatgcagattcacctggctgttgctcacatgggagtactggtgttacggggaaatacaaagatcaatacttttaactgggctaaaatccgcaagttgagttttaagagaaagcattttctcatcaaacttcatgccaatatcttggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctatagtggacgaacccaaaggcaacttttggaatatgggagaaaagggaggctgaagagcttgccatttgaaaggaaacattacccatctcagtaccatgaacgacagtgcaggtcctcaccagacctcctctctgatgtgtcaaaacaagtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaattataa

SEQ ID NO: 10706 - DNA, 3338 bp, Homo sapiens
gggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaatattt

SEQ ID NO: 10707 - DNA, 3352 bp, Homo sapiens
gggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttattt

SEQ ID NO: 10708 - DNA, 3369 bp, Homo sapiens
cacaggcagcgcttcgccagccgaggaaccggacgcggacaccgccgccccgcgagcctccagcccctcgcctgttgccgcgcgagtcccgggcccggagcgctaggagcgcgcggtgagggagcgggaccccgccgggacccgagggggcgcggcggggaggggaacggggagtcagcccgcgctgtgtctcggggccggccggcaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaatattt

SEQ ID NO: 10709 - DNA, 2082 bp, Homo sapiens
cagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtaaactcataacaatgttacttgaatatagtccttctctgatacaaattagtacattaagaataaaaaggcctataaattctga

SEQ ID NO: 10710 - DNA, 2064 bp, Homo sapiens
atggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtga

SEQ ID NO: 10711 - DNA, 587 bp, Homo sapiens
gtttcccagtaatgttaatgaacaaaaggttatctgcctagcgagttccttttccaagcgtttgagacaattcgacaagattatgagactgcgaactggagtcttttatctttaaaaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaaga

SEQ ID NO: 10712 - DNA, 2489 bp, Homo sapiens
gagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcgcatcccacgaaggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgt

SEQ ID NO: 10713 - DNA, 2477 bp, Homo sapiens
gagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgt

SEQ ID NO: 10714 - DNA, 1006 bp, Homo sapiens
acccgccctgctcgtgataaggcacaagcaagggctgccctgaaggaagctccaaagagaaaggagggcaggaagcccacggcccacaggggtgtagcccgagacccacctgcagcccccagcccttgccaggaaagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgc

SEQ ID NO: 10715 - DNA, 3206 bp, Homo sapiens
gggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatcta

SEQ ID NO: 10716 - DNA, 1897 bp, Homo sapiens
gcttgtgggcgggcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaacc

SEQ ID NO: 10717 - DNA, 1809 bp, Homo sapiens
acagatccacttgcaggttgctgttcccagccatggcttcgcgctgctggcgctggtggggctggtcggcgtggcctcggacccggctgcctcccgccgggagcaccccgacctttgggggttcagatgaagtaagagaccctgcaaatgccaaagccttgaggaacaagagaaggaggatgcaggtgagggtgaagcttgggaagttccagcttctgttggatattcaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaacctta

SEQ ID NO: 10718 - DNA, 1705 bp, Homo sapiens
agatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaag

SEQ ID NO: 10719 - DNA, 1967 bp, Homo sapiens
gcttgtgggcgggcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagagggtggaagccttgtgttctcagcccagggtcctgaactctcctgctctgtctggggaaggggaggacctgggggcgtcccagcctctctctctcgaccccaccagctgccaccctgttccccagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggt

SEQ ID NO: 10720 - DNA, 2157 bp, Homo sapiens
acagatccacttgcaggttgctgttcccagccatggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggcttctgccaccatttctccacacaggagaagaccccccagatctgtgtggtgggcagtggcccagctggcttctacacggcccaacacctgctaaagggagctccaagctactggctgtgctcctaagacaggaccacatgcagcacgtttgggacagtggcccttagcttgagtcaggcactgagcacagcatctcgtagcatcctcatgacaacctgcaaagcaggtgtcgtgcctcttgcttcacagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggaggtgagtctcatgtttctcaaagacacccccttcccaggcctctgccacccgcctggtgttgcccacactctccccaacagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaacc

SEQ ID NO: 10721 - DNA, 1827 bp, Homo sapiens
agagaatgtccttgttagcggggagcagctagagggacaggagggagggaaggaaggaaggaggaaacctggaagatgaggtcagccacgagagataaggggtaagaatatccggcagacttagcgttccggaggtggccctggagaggacatcgtgacccagagtgaaggatctgtcgcaggaaagaatggaagataaggacagagagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaag

SEQ ID NO: 10722 - DNA, 1827 bp, Homo sapiens
ggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaacc

SEQ ID NO: 10723 - DNA, 1766 bp, Homo sapiens
tagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagg

SEQ ID NO: 10724 - DNA, 2642 bp, Homo sapiens
atactgctgggattacaggcgcccgccaccacgcccggctaattttttgtatttttagtagagacggggtttcactgtgttggcaaggatggtctctatctcctgacctcgtgatatgcccgcctccgcctcccaaagtgctgggattacaggcttgagccaccgcgtctggcctatttatttattattttcgagacggagtgttgctcttgtggcccaggctggagtgcaacggcgggatttcggctcactgcaacctctgcctcccgggttcaagcaattctcctgcctcagcctcctgagtagctgggattacaggcaggcaccaccacacccggctaattttgtatttttagtagaaacggggtttctccatgttggtcagtctggtttcgaactcccagcgtcaggtcatctgcctgcctcggcctcccaaagtgctgggattacaggcgtgagccaccgcgcccagccacttctgtatttttaaaaaagtggtaaggaagtggaggattaaatgatttgcccaaagtctcacagtaatttgtagagctgagattgaaattcgggtgaaacttcacatatcacattctttttatcagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaagttactttgtcagggcatccatttaaaggctttctcctagaagcgcgtaatgctgaggatctgaatggccctcctattggctccttcacattgattgacagtgaagtgtcacaacttttgacctgtgaagatatacagggatcagcagtgagtcacagaagtgcatctaaaaaaacagaaattaaagtctactggaatgctccaagcagtgctccaaatcacacacagtttctagtcacagttgttgagaagtataaaatctactgggtgaagattcctggtcctataatttcacaaccaaatgcatttccttttacaacacctaaagctacagtagtacctttgccaacgttacctcccgtttcccacttaaccaaaccattcagtgcctcagattgtgggaacaagaagttctgtattaggagtcctttgaactgtgacccagagaaggaggcttcctgtgtcttcttgtccttcacaagagatgaccaatcggtgatggttgaaatgagcggccccagtaaaggctatttatcctttgcattgtctcatgatcagtggatgggtgatgatgatgcttatctgtgtattcatgaagatcagactgtgtacatccagccttcccatttaacggggcgaagtcaccctgtaatggactccagggatacccttgaggatatggcttggaggttggcggacggtgttatgcagtgttctttcagaagaaacattacccttcctggagttaagaatagatttgatctaaacacaagctattacatatttctagcagatggtgcagctaatgatggtcgaatttacaagcactctcagcaacctttgattacctatgaaaaatatgatgtgacagactctccaaagaacataggaggatcccattctgtactccttctgaaggttcatggtgccttaatgtttgtggcatggatgactactgttagcataggtgtactggttgcccggttcttcaagccagtttggtcaaaagctttcttgcttggtgaagcagcttggtttcaggtgcatcggatgctcatgttcaccacaactgtcctcacctgcattgcttttgttatgccgtttatatacaggggaggctggagtaggcatgcaggttaccacccatacctcggctgtatagtgatgactttggcagttcttcagcctcttctggcagtcttcaggccacctttacatgacccaagaaggcaaatgtttaactggactcattggagtatgggaacagctgctagaataatagcagtggcagcgatgttcctgggaatggatttaccaggactgaatcttcctgattcatggaaaacctatgcaatgaccggattcgtagcctggcatgttgggactgaggttgttctggagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtagaggaattctgaagtccagcctttagagaacaacattcaagagggtcatatagactataaattaatgtcatgccctatatgtaattctgggtcttaaaggaaagattgtacttcaggagaagtaactctcaaatatttcatgccaagattttaagaatgt

SEQ ID NO: 10725 - DNA, 2706 bp, Homo sapiens
atactgctgggattacaggcgcccgccaccacgcccggctaattttttgtatttttagtagagacggggtttcactgtgttggcaaggatggtctctatctcctgacctcgtgatatgcccgcctccgcctcccaaagtgctgggattacaggcttgagccaccgcgtctggcctatttatttattattttcgagacggagtgttgctcttgtggcccaggctggagtgcaacggcgggatttcggctcactgcaacctctgcctcccgggttcaagcaattctcctgcctcagcctcctgagtagctgggattacaggcaggcaccaccacacccggctaattttgtatttttagtagaaacggggtttctccatgttggtcagtctggtttcgaactcccagcgtcaggtcatctgcctgcctcggcctcccaaagtgctgggattacaggcgtgagccaccgcgcccagccacttctgtatttttaaaaaagtggtaaggaagtggaggattaaatgatttgcccaaagtctcacagtaatttgtagagctgagattgaaattcgggtgaaacttcacatatcacattctttttatcagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaagttactttgtcagggcatccatttaaaggctttctcctagaagcgcgtaatgctgaggatctgaatggccctcctattggctccttcacattgattgacagtgaagtgtcacaacttttgacctgtgaagatatacagggatcagcagtgagtcacagaagtgcatctaaaaaaacagaaattaaagtctactggaatgctccaagcagtgctccaaatcacacacagtttctagtcacagttgttgagaagtataaaatctactgggtgaagattcctggtcctataatttcacaaccaaatgcatttccttttacaacacctaaagctacagtagtacctttgccaacgttacctcccgtttcccacttaaccaaaccattcagtgcctcagattgtgggaacaagaagttctgtattaggagtcctttgaactgtgacccagagaaggaggcttcctgtgtcttcttgtccttcacaagagatgaccaatcggtgatggttgaaatgagcggccccagtaaaggctatttatcctttgcattgtctcatgatcagtggatgggtgatgatgatgcttatctgtgtattcatgaagatcagactgtgtacatccagccttcccatttaacggggcgaagtcaccctgtaatggactccagggatacccttgaggatatggcttggaggttggcggacggtgttatgcagtgttctttcagaagaaacattacccttcctggagttaagaatagatttgatctaaacacaagctattacatatttctagcagatggtgcagctaatgatggtcgaatttacaagcactctcagcaacctttgattacctatgaaaaatatgatgtgacagactctccaaagaacataggaggatcccattctgtactccttctgaaggttcatggtgccttaatgtttgtggcatggatgactactgttagcataggtgtactggttgcccggttcttcaagccagtttggtcaaaagctttcttgcttggtgaagcagcttggtttcaggtgcatcggatgctcatgttcaccacaactgtcctcacctgcattgcttttgttatgccgtttatatacaggggaggctggagtaggcatgcaggttaccacccatacctcggctgtatagtgatgactttggcagttcttcagcctcttctggcagtcttcaggccacctttacatgacccaagaaggcaaatgtttaactggactcattggagtatgggaacagctgctagaataatagcagtggcagcgatgttcctgggaatggatttaccaggactgaatcttcctgattcatggaaaacctatgcaatgaccggattcgtagcctggcatgttgggactgaggttgttctggaggtacatgcttatcggctctctcgcaaagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtagaggaattctgaagtccagcctttagagaacaacattcaagagggtcatatagactataaattaatgtcatgccctatatgtaattctgggtcttaaaggaaagattgtacttcaggagaagtaactctcaaatatttcatgccaagattttaagaatgttggtatttaagaaaataaatagtgatttggaaaatc

SEQ ID NO: 10726 - DNA, 870 bp, Homo sapiens
ggcggcgctatgctgtcctgcttcaggctcctctccaggcacatcagcccttcgctggcgtctctgcgcccggtgcgctgctgcttcgcgctcccgctgcgttgggccccggggcgccccttggaccccaggcagatcgccccccgccgccccctggccgcagccgcctcctcccgggaccctaccgggcccgccgccggcccctctcgggtgcgccagaacttccaccccgactccgaggctgccatcaaccgccagatcaacctcgagctctatgcgtcctacgtgtacttgtccatggcctattacttctcccgggatgacgtggccttgaacaacttctccaggtatttccttcaccagtcccgggaggagaccgagcacgcggagaagctgatgaggctgcagaaccagcgaggaggccggatccgcctgcaggacatcaagaagccggaacaggacgactgggaaagcgggctgcatgccatggagtgtgctctactcttggaaaagaacgtgaaccagtcgttgctggaattgcacgctctagcctcagataaaggtgacccccatttgtgcgatttcctggaaacctactacctgaatgagcaggtgaagtctatcaaagaactaggtgaccacgtgcacaacttagtgaagatgggggccccggatgctggcctggcggagtacctttttgacacacatacccttggaaatgaaaacaagcagaactaagccacgagctgccttcctcccaggctagtggatccaaagaccaaagtcagctgtctcctgctttcttgcccttaaaatcacctccatctttatattcttctgttatactattcctccaataaagtgatttgt

SEQ ID NO: 10727 - DNA, 1229 bp, Homo sapiens
ataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaa

SEQ ID NO: 10728 - DNA, 860 bp, Homo sapiens
tcggggtttcctgcttcaacagtgcttggacggaacccggcgctcgttccccaccccggccggccgcccatagccagccctccgtcacctcttcaccgcaccctcggactgccccaaggcccccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 10729 - DNA, 786 bp, Homo sapiens
ggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaa

SEQ ID NO: 10730 - DNA, 811 bp, Homo sapiens
cacccgcctttcactatccgccattcttgtcacctcagctgctgccctcgctaccgcaccgacttcgcccgtgtgctcgcctgcacttgcgctgcccgccatggccaccgcccagccgtcgcaggtgcgccagaagtacgacaccaactgcgacgccgccatcaacagccacatcacgctggagctctacacctcctacctgtacctgtctatggccttctacttcaaccgggacgacgtggccctggagaacttcttccgctacttcctgcgcctgtcggacgacaaaatggagcatgcccagaagctgatgaggctgcagaacctgcgcggtggccacatctgccttcacgatatcaggaagccagagtgccaaggctgggagagcgggctcgtggccatggagtccgccttccacctggagaagaacgtcaaccagagcctgctggatctgtaccagctggccgtggagaagggcgacccccagctgtgccacttcctggagagccactacctgcacgagcaagtcaagaccatcaaagagctgggtggctacgtgagcaacctgcgcaagatttgttccccggaagccggcctggctgagtacctgttcgacaagctcaccctgggcggccgcgtcaaagagacttgagcccagatgggccccacagccacggggtcccttccctgggtcaggccactaggcggggcgtgcatgttgccctttcagaacgttctcttcagttttatctttcagttttaccattgttagcaaaaaagttatctggttctcaaagcaataaaggtgtcc

SEQ ID NO: 10731 - DNA, 870 bp, Homo sapiens
gcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 10732 - DNA, 573 bp, Homo sapiens
atgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctctcgaaaggctcactctcaagcacgactaagagccttctgagcccagcgacttctgaagggccccttgcaaagtaa

SEQ ID NO: 10733 - DNA, 3853 bp, Homo sapiens
cggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgcccatgtctgtggtcaacagaggcgacccatatcctcaggaggtaagcgccactgtccaaaaagtcatggaaaggctggagtactgcaacccctaccgactggtgtggcaatccaaggttggtccaatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttctttttttttttttttttagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggagaaatgaa

SEQ ID NO: 10734 - DNA, 2526 bp, Homo sapiens
aggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggtatgagtctaacatcaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgcccatgtctgtggtcaacagaggcgacccatatcctcaggaggtaagcgccactgtccaaaaagtcatggaaaggctggagtactgcaacccctaccgactggtgtggcaatccaaggttggtccaatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatg

SEQ ID NO: 10735 - DNA, 1627 bp, Homo sapiens
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaaca

SEQ ID NO: 10736 - DNA, 1410 bp, Homo sapiens
gtcagcatttgtccagccctgctggagagccactaggagaggcatcagtctccagtacaaattaacaaaccggctgctggcttatgtatcagttgcctatgcatagggtcagtatactcacccccaggcctgaacaactctgggtcctcaggaaccctgaaggtgtgactggcaaagctgaggccctggctcgggagctgcttccctgagaggactgcgcctacagcatccttgacatcttttcataaaccagcacaactaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatga

SEQ ID NO: 10737 - DNA, 1441 bp, Homo sapiens
agcatttgtccagccctgctggagagccactaggagaggcatcagtctccagtacaaattaacaaaccggctgctggcttatgtatcagttgcctatgcatagggtcagtatactcacccccaggcctgaacaactctgggtcctcaggaaccctgaaggtgtgactggcaaagctgaggccctggctcgggagctgcttccctgagaggactgcgcctacagcatccttgacatcttttcataaaccagcacaacttttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggaggcgtgagcaactaatgcccagcacagtttcagtccctaaattccctttaattccaggacaggtattagctgcgta

SEQ ID NO: 10738 - DNA, 1879 bp, Homo sapiens
gcggcgagtggagcgggagccgactggaagaagggctctagggagggggctgtggctgctggggtccgaggtggggccgggtacaccagccccatcactgtttgcagagagtcagggaggcggaaaagacacgcgctctaggctcccatcagggcacatggcccgggcccatcccccgcgcgtctccccggctgcggggcgcggggggctgccgggtgcgcttggctgtggcgcggcgcgttggagactttattgcgatgggacgataagaggggcgggggcggggtcctgggggccgaggcggcagcgctttaattaaaacggaaattgcggccccgggccgcgcgggggccggagggttccaagcggccccttagctggaagcgtttctccaggacccccccgcaacccccgccacgcccgggctgccccctcccgccaggccctgccggacccggcgccgtcttctcctccttgtcacccgcggtcgcttcgggcggggatcggtgccaccgagcgcaaagcctgcctcgccccccttccccgtcccccccatctcccaccgcccagtccccggcggcgatgagacagagcggcgcctcccagcccctgctgatcaacatgtacctgccagatcccgtcggagacggtctcttcaaggacgggaagaacccgagctgggggccgctgagccccgcggttcagaaaggcagcggacagatccagctgtggcagtttctgctggagctgctggctgaccgcgcgaacgccggctgcatcgcgtgggagggcggtcacggcgagttcaagctcacggacccggacgaggtggcgcggcggtggggcgagcgcaagagcaagcccaacatgaactacgacaagctgagccgcgccctgcgctactactacgacaagaacatcatgagcaaggtgcatggcaagcgctacgcctaccgcttcgacttccagggcctggcgcaggcctgccagccgccgcccgcgcacgctcatgccgccgccgcagctgctgccgccgccgcggccgcccaggacggcgcgctctacaagctgcccgccggcctcgccccgctgcccttccccggcctctccaaactcaacctcatggccgcctcggccggggtcgcgcccgccggcttctcctactggccgggcccgggccccgccgccaccgctgccgccgccaccgccgcgctctaccccagtcccagcttgcagcccccgcccgggcccttcggggccgtggccgcagcctcgcacttggggggccattaccactagacggggcggtcgggtgcctgcggcctcgcccgcacgcctagagtctcgcccgatcccatcggcatcccggggagggcccgggagcctccgtcaaccgtcctctaatccagagtttactccacctgccgcacttagcagggggacgggaccgaagctccctcaatccttgtctggtactagatttgctcctgtcccaccccgcagtcccctgaggagggcgatgtgcgccctctttcactttttttcttctaggtctccaggtcccggaggggatttgtggacctctcttgtctccccaccactccagtgcatttccgcctggctcctagaagccccattcaatatcactactctttaacgagtgccaaatcttttcccacttttgctcttccccaaggaactgctcccacctcagcacgtggaggcctctcacggtcctccttcctgggacctgagcaggtttggtgaaagccaccgtcctccgtgacacacggcccccttcctcctgtccccacactcccaggagaaactcccggtgtgtttctgaccctttcagccccattaaagctcctgagctctc

SEQ ID NO: 10739 - DNA, 2019 bp, Homo sapiens
atggacagtagctgccacaacgcgactaccaaaatgttagcgactgctccagctcggggcaacatgatgagcacgtccaaacccttggctttctccattgaacgaatcatggcgcgcaccccagagcccaaggccctgccagtcccccacttcctgcagggagccttacccaagggggaacccaagcactctctgcatctcaactcgtcgatcccctgcatgatccccttcgtgcctgtggcctacgacacgagccccaaggcaggagtgacgggctccgagccgcggaaggccagtctggaggccccggcggcgcccgcggcggtgccctcggctcccgcattcagctgcagcgacctgctcaactgcgcactgagtctcaagggcgacctggcccgcgacgcgctgccgctgcagcagtacaagctggtaaggccgcgtgtggtcaaccactcttcattccacgccatgggcgccttgtgctacctgaaccgaggtgacggcccatgccacccggcagccggcgtgaacatccacccggtggcctcctacttcctcagttcccctttgcacccgcagccaaaaacgtatttagccgaaaggaataaactggtggtcccggcggtggagaaatacccttctggagtagctttcaaagacctgtcccaggctcagctgcagcattacatgaaagaaagcgcccagcttctgtcggaaaaaatcgcgttcaaaacctcggatttcagccgaggctctcctaatgccaagcccaaagttttcacttgcgaagtctttaatgcgcactataacttaacccgtcacatgccagtgcacacaggagccagacccttcgtttgcaaagtgtgcggaaaaggtttcaggcaagcaagcaccctgtgcaggcacaagatcattcacacgcaggaaaaacctcacaaatgtaaccagtgtggcaaagcatttaatagaagttccactttaaacactcatacccgaatacacgcgggctacaaaccgtttgtgtgtgaattctgtggcaaagggtttcatcaaaaagggaattacaaaaaccacaagttgacccacagcggggagaagcagttcaagtgcaatatctgcaacaaggctttccaccaggtttacaacctcaccttccacatgcacacccacaacgacaagaagcctttcacctgccccacgtgcggcaagggtttctgcaggaactttgacctcaagaagcatgtccgcaagctgcacgacagcagcctggggctggcccgcacgccagctggcgaaccaggcactgaaccgccgcccccgctaccgcagcagccgccgatgacgctgcctcctctgcagccgccgctgccaaccccggggcccctgcagcccgggctccaccagggccaccagtgatcgaggctaagggtcctcccagcctcagccgtgcccccacgctgaggcagcggcagactagagctcctggtccgagttcgtctgcagaccccagggcatgttgggccccacacttcagggccgaccagaagcctctgcatcccctggcctttcgcctcttgcatgcacctgctaaatggttttgtgtattatattctatataggcactaacaattatgaaaaatttggagggttttgcttgttttctgtttttctttttctttttttttaatttggaaagacttttcatcttgggtggagagatggtgtttattttgttttgttttgtttaaacaaatttctgctatatttattgagatctgtattattctacccgggaatgctgcatcattttaattttattattgtatatatttccattgtgttgattctccggtctcaagatgtctgctggatgttgatcatttcctctttccctgaagtaacaaaacactgtgtgtatgtcatatatacacgcatagatgtgtgcgcccataggggtacattccacattcgtgagcacacacccatacacattagataagggtggttcattatggatga

SEQ ID NO: 10740 - DNA, 688 bp, Homo sapiens
gcccgaggtcggcgggacctgatcgaaggcagcgccgcgtcgaccaccccgggagccggacgcttgggagccccagcccggcagcggcgcccggtcactgaagttgcgccccaactcccagccgcctccaagcttctcgagctaagtttcctgacccctccaagggagtctcacagagctcggtggccctcggccttgccaacgtcactttaactgtttggaactcgtgagcaagaaccgagaagtggagagcccagccggggagttttcagcttttctgtttcacttcgggcttcttctattcaaatggctctgcgctggccaccgaatcctgaatgaggcggggctcctctgccccaactccagcagcgggaacttggttcccctgggcagccgggggcagggggcgccaaggccgtggcgataatgaaggctgagacggccaaggccagcgggtcggcgcggggcactcccgggccggagtggccatcggccggagttcaggaggtctgtgacaagcagggaacaaggcaacggacggcgcaacccagccccggctgacggacgctggcgactcagacatggacagtagctgccacaacgcgactaccaaaatgttagcgactgctccagctcggggcaacatgatgagcacgtccaaacccttggctttctccattgaacgaat

SEQ ID NO: 10741 - DNA, 1368 bp, Homo sapiens
cagggaacaaggcaacggacggcgcaacccagccccggctgacggacgctggcgactcagacatggacagtagctgccacaacgcgactaccaaaatgttagcgactgctccagctcggggcaacatgatgagcacgtccaaacccttggctttctccattgaacgaatcatggcgcgcaccccagagcccaaggccctgccagtcccccacttcctgcagggagccttacccaagggggaacccaagcactctctgcatctcaactcgtcgatcccctgcatgatccccttcgtgcctgtggcctacgacacgagccccaaggcaggagtgacgggctccgagccgcggaaggccagtctggaggccccggcggcgcccgcggcggtgccctcggctcccgcattcagctgcagcgacctgctcaactgcgcactgagtctcaagggcgacctggcccgcgacgcgctgccgctgcagcagtacaagctgccaaaaacgtatttagccgaaaggaataaactggtggtcccggcggtggagaaatacccttctggagtagctttcaaagacctgtcccaggctcagctgcagcattacatgaaagaaagcgcccagcttctgtcggaaaaaatcgcgttcaaaacctcggatttcagccgaggctctcctaatgccaagcccaaagttttcacttgcgaagtgtgtggaaaggtctttaatgcgcactataacttaacccgtcacatgccagtgcacacaggagccagacccttcgtttgcaaagtgtgcggaaaaggtttcaggcaagcaagcaccctgtgcaggcacaagatcattcacacgcaggaaaaacctcacaaatgtaaccagtgtggcaaagcatttaatagaagttccactttaaacactcatacccgaatacacgcgggctacaaaccgtttgtgtgtgaattctgtggcaaagggtttcatcaaaaagggaattacaaaaaccacaagttgacccacagcggggagaagcagttcaagtgcaatatctgcaacaaggctttccaccaggtttacaacctcaccttccacatgcacacccacaacgacaagaagcctttcacctgccccacgtgcggcaagggtttctgcaggaactttgacctcaagaagcatgtccgcaagctgcacgacagcagcctggggctggcccgcacgccagctggcgaaccaggcactgaaccgccgcccccgctaccgcagcagccgccgatgacgctgcctcctctgcagccgccgctgccaaccccggggcccctgcagcccgggctccaccagggccaccagtgatcgaggctaagggtcctcccagcctcag

SEQ ID NO: 10742 - DNA, 2099 bp, Homo sapiens
gacaagcagggaacaaggcaacggacggcgcaacccagccccggctgacggacgctggcgactcagacatggacagtagctgccacaacgcgactaccaaaatgttagcgactgctccagctcggggcaacatgatgagcacgtccaaacccttggctttctccattgaacgaatcatggcgcgcaccccagagcccaaggccctgccagtcccccacttcctgcagggagccttacccaagggggaacccaagcactctctgcatctcaactcgtcgatcccctgcatgatccccttcgtgcctgtggcctacgacacgagccccaaggcaggagtgacgggctccgagccgcggaaggccagtctggaggccccggcggcgcccgcggcggtgccctcggctcccgcattcagctgcagcgacctgctcaactgcgcactgagtctcaagggcgacctggcccgcgacgcgctgccgctgcagcagtacaagctggtaaggccgcgtgtggtcaaccactcttcattccacgccatgggcgccttgtgctacctgaaccgaggtgacggcccatgccacccggcagccggcgtgaacatccacccggtggcctcctacttcctcagttcccctttgcacccgcagccaaaaacgtatttagccgaaaggaataaactggtggtcccggcggtggagaaatacccttctggagtagctttcaaagacctgtcccaggctcagctgcagcattacatgaaagaaagcgcccagcttctgtcggaaaaaatcgcgttcaaaacctcggatttcagccgaggctctcctaatgccaagcccaaagttttcacttgcgaagtgtgtggaaaggtctttaatgcgcactataacttaacccgtcacatgccagtgcacacaggagccagacccttcgtttgcaaagtgtgcggaaaaggtttcaggcaagcaagcaccctgtgcaggcacaagatcattcacacgcaggaaaaacctcacaaatgtaaccagtgtggcaaagcatttaatagaagttccactttaaacactcatacccgaatacacgcgggctacaaaccgtttgtgtgtgaattctgtggcaaagggtttcatcaaaaagggaattacaaaaaccacaagttgacccacagcggggagaagcagttcaagtgcaatatctgcaacaaggctttccaccaggtttacaacctcaccttccacatgcacacccacaacgacaagaagcctttcacctgccccacgtgcggcaagggtttctgcaggaactttgacctcaagaagcatgtccgcaagctgcacgacagcagcctggggctggcccgcacgccagctggcgaaccaggcactgaaccgccgcccccgctaccgcagcagccgccgatgacgctgcctcctctgcagccgccgctgccaaccccggggcccctgcagcccgggctccaccagggccaccagtgatcgaggctaagggtcctcccagcctcagccgtgcccccacgctgaggcagcggcagactagagctcctggtccgagttcgtctgcagaccccagggcatgttgggccccacacttcagggccgaccagaagcctctgcatcccctggcctttcgcctcttgcatgcacctgctaaatggttttgtgtattatattctatataggcactaacaattatgaaaaatttggagggttttgcttgttttctgtttttctttttctttttttttaatttggaaagacttttcatcttgggtggagagatggtgtttattttgttttgttttgtttaaacaaatttctgctatatttattgagatctgtattattctacccgggaatgctgcatcattttaattttattattgtatatatttccattgtgttgattctccggtctcaagatgtctgctggatgttgatcatttcctctttccctgaagtaacaaaacactgtgtgtatgtcatatatacacgcatagatgtgtgcgcccataggggtacattccacattcgtgagcacacacccatacacattagataagggtggttcattatggatga

SEQ ID NO: 10743 - DNA, 2074 bp, Homo sapiens
cttttaaagtttgaggggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaaca

SEQ ID NO: 10744 - DNA, 1918 bp, Homo sapiens
cctgttcatttgaatgcaaatgggtgacccgggcccgactaggtgcttattaaattgcagttttcccccctgccttttccggaatgcagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactc

SEQ ID NO: 10745 - DNA, 2001 bp, Homo sapiens
gatgggaccttctcaattatacaaacatgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacagaa

SEQ ID NO: 10746 - DNA, 1484 bp, Homo sapiens
gcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaa

SEQ ID NO: 10747 - DNA, 3871 bp, Homo sapiens
cgccgaccctaagtttcggcgctcagtggtccggcgctccccaaggctcggtgtccagcgtcaaccccgaggtctctatgccccgcctcccgacgccagggggcagggccagcgcgctgcgcgtcggggcggggctttggctgcgtcggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagataccaaggtataaaggacaaggtaagaagaagacaagcgggcagaaggctggtgacaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgata

SEQ ID NO: 10748 - DNA, 1391 bp, Homo sapiens
ttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagacaatcactcagctggaatgtctgctctctattggtgccttgcatttcaaaaacactgcagatatttttaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggc

SEQ ID NO: 10749 - DNA, 1164 bp, Homo sapiens
gcgtcacgcagcgcacgtcgccgcgcgcctgcgctcttttccacgtgcgaaagccccggactcgtggagttgtgaacgccgcggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtctccc

SEQ ID NO: 10750 - DNA, 11756 bp, Homo sapiens
gtggtgatgagggcgacgaaggagggggtgtcattttctttttctttctttttttaaaaaaagtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttgccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatgtcagccccagtttaatacacacggtcccaattatagagctactcactgaaagaatgggtttccttgcattgtggtgagctccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggggaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttgatgctgca

SEQ ID NO: 10751 - DNA, 11757 bp, Homo sapiens
agtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttgccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacgtcatcctttctcttttactgctgtctccagctttcccctcttgcttcttctcacccaggacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatgtcagccccagtttaatacacacggtcccaattatagagctactcactgaaagaatgggtttccttgcattgtggtgagctccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggggaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttgatgctgca

SEQ ID NO: 10752 - DNA, 8365 bp, Homo sapiens
agtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgcacctacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatgtcagccccagtttaatacacacggtcccaattatagagctactcactgaaagaatgggtttccttgcattgtggtgagctccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggggaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttgatgctgca

SEQ ID NO: 10753 - DNA, 10724 bp, Homo sapiens
ctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 10754 - DNA, 11132 bp, Homo sapiens
ggcagttagggcaactggaaggctgggagctgaaatcacctgaagtctcattcactcacatgtctgatggttgatattgtctatcagattcttttttgtctccttctctgcaagaggctggcaccagatcacctcctgagtagagcagacattccaaaggatgtcctgccaacaataatggaaagctggatacaactgaatatgtaaaatgatgttaatgaagaattgaagagcactgtatctagttttctgctctccccttattttgaatcaaacccaggcatcctatcatttcatctataaagactttagttcctaaaagtggaattgctggatcaaagggtaaaggcataggcaattctagagcatttagatttaatgtgatggacaggaatgaaccatgaagccacgagtgtttgatttttaaattgtgatattccactaaatgagaaatgaccaggacttcacagagatttcatgaaaggagggccacaaaggaagaacccagagcaggccggtgagaggcactctaagagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaa

SEQ ID NO: 10755 - DNA, 1316 bp, Homo sapiens
gcgcgcagcgcgagcggcgggcgttgggctggcggctttcgcgctcccgctcctgctcccgcccgcacacagcggcgcgctcatcctcacacgcccgcccgctcccgggccgccccggcgcggggcacagaggcggggacccggcggacagagcgcgccccgcgcccgcgcccgcgcccaccccgtctcctttgcgctccgcagcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctaggaccgctagactggtgcaccttgtccttggccctgctggtccctgtcgccccatccccgaccccacctcactctttcgtgaatgttctccacccacctgtgcctggcggacccactctccagtag

SEQ ID NO: 10756 - DNA, 3104 bp, Homo sapiens
tttgaagcttcagacaagaggcaaggcctttcctgtggccactgtcagaagaaagagagaacactgcttgccctggttcccttgggcctgccctctcctgggccagccttctctcctcccttgtggccaggtttgtctcacccactgacatgctgtgtggccctggcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgca

SEQ ID NO: 10757 - DNA, 3253 bp, Homo sapiens
gcgcagcgcgagcggcgggcgttgggctggcggctttcgcgctcccgctcctgctcccgcccgcacacagcggcgcgctcatcctcacacgcccgcccgctcccgggccgccccggcgcggggcacagaggcggggacccggcggacagagcgcgccccgcgcccgcgcccgcgcccaccccgtctcctttgcgctccgcagcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgca

SEQ ID NO: 10758 - DNA, 2440 bp, Homo sapiens
tcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgca

SEQ ID NO: 10759 - DNA, 3119 bp, Homo sapiens
ttccctaggtcttttcggaggcggagtttagtatccaagtccgcgggtgtgagcgcgcgcgtgtgtcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgcaga

SEQ ID NO: 10760 - DNA, 1046 bp, Homo sapiens
ggagccgggccgcccgcggctgtttgctgccctccggccggccgcgttatctgggggccagttcggcctcctttccctaggtcttttcggaggcggagtttagtatccaagtccgcgggtgtgagcgcgcgcgtgtgtcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggag

SEQ ID NO: 10761 - DNA, 3281 bp, Homo sapiens
gcgcgcagcgcgagcggcgggcgttgggctggcggctttcgcgctcccgctcctgctcccgcccgcacacagcggcgcgctcatcctcacacgcccgcccgctcccgggccgccccggcgcggggcacagaggcggggacccggcggacagagcgcgccccgcgcccgcgcccgcgcccaccccgtctcctttgcgctccgcagcggcgcgcctcgcccggcgcccccgccagtcctgccggaagatggtcaacgaccggtggaagaccatgggcggcgctgcccaacttgaggaccggccgcgcgacaagccgcaggcgaggaaactgaggctcagagagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgcaga

SEQ ID NO: 10762 - DNA, 1630 bp, Homo sapiens
gagatgacatattaattcatatttttgtgggtaaaatgttattacccttaatacaaagcaaagtttcagctggacttcgtttttacttaatcttcaatggaacattattgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttaggcaattttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaatatttattgaa

SEQ ID NO: 10763 - DNA, 1335 bp, Homo sapiens
aatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 10764 - DNA, 1374 bp, Homo sapiens
aattacaaattcccaatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 10765 - DNA, 1462 bp, Homo sapiens
aatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 10766 - DNA, 1967 bp, Homo sapiens
gatcaggtctccacagcagcggaacaacacttttctggacagaaagttaatttacatgaaggaaaaacggtctggtggaaggataccagaactaaaacttgggaattaagaaaaattatgacgcggggaagggcttttgcttgtgtttcaccaggagacaatcaaacacccatttagatacccaatagacatttgaaattctgcaatgaaccctacaccgaccggacagaagaaagggaagaatccaaagaggaagaagactggtccctccgacctgtcctttcgggagctgagaaagatgacgaagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaggacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccattacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaatatttattgaa

SEQ ID NO: 10767 - DNA, 1247 bp, Homo sapiens
aattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 10768 - DNA, 1093 bp, Homo sapiens
agggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgct

SEQ ID NO: 10769 - DNA, 1713 bp, Homo sapiens
gaaagatgacgaagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaggacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccattacaggatcctgggaagcagagtgtctggatggaacctgagctgggtctctgactcacttctgactttaggcaaatggagggaatctgataaagacatcttataaattcaacagacacaaaagaatttgatctcccataagcaactgtgaaattacaataacagatcctgggaagttctacaattctaattcaggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaatattta

SEQ ID NO: 10770 - DNA, 1367 bp, Homo sapiens
gtgatgaaacagattcaattctagttaacactcagtgtcattctgtgtggtgagaggctgggaaagtctgggagaatttcctcggcgactctaagattagggatggcctgcggctgcatccgacttcctggagctactgaagtctgaactctggtctcatgaaaaattcaaggttgatacatttataaaattctttttgttcttgcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaata

SEQ ID NO: 10771 - DNA, 4261 bp, Homo sapiens
gcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgcattttaaaggagtcctttgttgttatgctgttatccaatgaacacttgcaagcaattagcaatattgagaattatacattagatttacaattcttttaatttctattgaaactttttctattgcttgtattacttgctgtatttaaaaaataattgttggctgggtgtggtagctcacgcctgtaatcccagcactttggaatgtcaaggcaggcagatcacttgaggtcaggagtttgagaccagcctggccaaacatgtgaaacgctgtctctattaaaaatacaaaaattagccgggcatggtggtacatgcctgtaatcctagctacttgggaggctgaggcaggagaatcgcttgaacctgagaggaagaggttgcagtgagccaagactgagccactgcactccagcatgggtgacagagaaaactctgtctcaaacaaaaaaataataaaatttattcagtaggctggattctacacaaagtaatctgtatttgggccatgatttaagcacatctgaaggtatatcactcttttcaggctataattatttgggtaatcttcattctgagacaaacttaatctatatcatttactttgcaacagaacaaccctacagcattttggttcccagactaagggaactaatatctatataattaaacttgttcatttatcattcatgaaatataaaatacttgtcatttaaaccgtttaaaaatgtggtagcataatgtcaccccaaaaagcattcagaaagcaatgtaactgtgaagaccagggtttaaaggtaattcatttatagtttataactccttagatgtttgatgttgaaaactgctttaacatgaaaattatcttcctctgctctgtgtgaacaatagcttttaatttaagattgctcactactgtactagactactggtaggtttttttggggggggtgggtagggatatgtgggtaatgaagcatttacttacaggctatcatactctgaggccaattttatctccaaagcaataatatcattaagtgattcacttcatagaaggctaagtttctctaggacagatagaaaacatgaattttgaaatatatagaacagtagttaaaatactatatatttcaaccctggctggtagattgcttattttactatcagaaactaaaagatagatttttacccaaacagaagtatctgtaatttttataattcatcaattctggaatgctatatataatatttaaaagactttttaaatgtgtttaatttcatcatcgtaaaaagggatcatctcagagagaacagcagtattctgcgtatttttaaaaatgctctagagtaacatttgaagtaattcactgtagtgtatgccagtcctagaaataatttttttaatttctggtgtctgtttctaatacactaaccaagttttcaaaatatatttacaaagatgcatctttacccattattttaaaatgattaaggaggatagttgcttcaggtaacaagctaatttttcaaatattaggcccttacagaactatttagtcaaaaagtaagatattcctttaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtaaatgatgtaactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataa

SEQ ID NO: 10772 - DNA, 1261 bp, Homo sapiens
ggtcccgatgccgcgagcggaatctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 10773 - DNA, 1248 bp, Homo sapiens
ataagctgggtcccgatgccgcgagcggaatctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 10774 - DNA, 5925 bp, Homo sapiens
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaaggtgtggaacctgaaggctcccctggtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 10775 - DNA, 2380 bp, Homo sapiens
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagttcccatagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaaca

SEQ ID NO: 10776 - DNA, 3816 bp, Homo sapiens
cttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgctt

SEQ ID NO: 10777 - DNA, 4157 bp, Homo sapiens
gcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggatggcagctgtgacccgggatttcggtgagatgcttctgcactctggccgggtcctgccagccgaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttc

SEQ ID NO: 10778 - DNA, 5900 bp, Homo sapiens
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagttcccatagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtgctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 10779 - DNA, 3824 bp, Homo sapiens
cttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttca

SEQ ID NO: 10780 - DNA, 5702 bp, Homo sapiens
gccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctga

SEQ ID NO: 10781 - DNA, 2953 bp, Homo sapiens
gtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgt

SEQ ID NO: 10782 - DNA, 2870 bp, Homo sapiens
aacttttcctccaactcgcgctcgggagctggcgaggcggcggcggctcctcaaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggca

SEQ ID NO: 10783 - DNA, 3680 bp, Homo sapiens
gctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatt

SEQ ID NO: 10784 - DNA, 587 bp, Homo sapiens
aactcgcgctcgggagctggcgaggcggcggcggctcctcaaccttgattctgcagtgggacctcccaggcccccttgccccccgcaacttctggactcatatccgtcagacatcacttgtcaccttccagcatcagggagaactggatccctcctggctccacactcttaggctctttggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctc

SEQ ID NO: 10785 - DNA, 5375 bp, Homo sapiens
ccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctga

SEQ ID NO: 10786 - DNA, 529 bp, Homo sapiens
aaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctgtgggacctcccaggcccccttgccccccgcaacttctggactcatatccgtcagacatcacttgtcaccttccagcatcagggagaactggatccctcctggctccacactcttaggctctttggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacac

SEQ ID NO: 10787 - DNA, 389 bp, Homo sapiens
caaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatgggtcagtttgaaaaggaggatcgagctcactgtggagtatccatggagatgtggagccttgtcaccaacctctaactgcagaactgggatgtg

SEQ ID NO: 10788 - DNA, 5900 bp, Homo sapiens
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 10789 - DNA, 1155 bp, Homo sapiens
tttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaa

SEQ ID NO: 10790 - DNA, 657 bp, Homo sapiens
ttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacg

SEQ ID NO: 10791 - DNA, 688 bp, Homo sapiens
ccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcatt

SEQ ID NO: 10792 - DNA, 467 bp, Homo sapiens
accacctccctccttaacatttctggagacttggagatgcggcgttgagattcgggggagaaaagaaagttcccttggatcccgagttatttaagatctcaccaagttattcgccgccgctgggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaa

SEQ ID NO: 10793 - DNA, 5590 bp, Homo sapiens
agcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataatta

SEQ ID NO: 10794 - DNA, 2593 bp, Homo sapiens
cgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattc

SEQ ID NO: 10795 - DNA, 2472 bp, Homo sapiens
ggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 10796 - DNA, 3005 bp, Homo sapiens
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagtcagcctctcgaaccgtattcaccttgttatcctgacccaagatga

SEQ ID NO: 10797 - DNA, 3547 bp, Homo sapiens
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaa

SEQ ID NO: 10798 - DNA, 3690 bp, Homo sapiens
aatttgttgaggaatttccccctagccttgaccccttgacagctcccgctcctactcagtgctggggagaagtagggaggccttaagcgaagagatgggtctgcactttggaggagccggacactgttgactttcctgatgtgaaatctacccaggaacaaaacaccagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 10799 - DNA, 4255 bp, Homo sapiens
cccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactta

SEQ ID NO: 10800 - DNA, 1680 bp, Homo sapiens
ccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtgggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagacc

SEQ ID NO: 10801 - DNA, 3001 bp, Homo sapiens
gagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcacctgtaatcccagctactccgggaggctgaggcaggagagtcacttgaaccggggaggcggaggttgcagtgagccgagatcatgccattgcattccagccttggcgacagagcgagactccgtctcaaaaaaaaaaaaaataaaaa

SEQ ID NO: 10802 - DNA, 2650 bp, Homo sapiens
ggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcacctgtaatcccagctactccgggaggctgaggcaggagagtcacttgaaccggggaggcggaggttgcagtgagccgagatcatgccattgcattccagccttggcgacagagcgagactccgtct

SEQ ID NO: 10803 - DNA, 2727 bp, Homo sapiens
cgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgag

SEQ ID NO: 10804 - DNA, 3003 bp, Homo sapiens
ggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacc

SEQ ID NO: 10805 - DNA, 3244 bp, Homo sapiens
ccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaa

SEQ ID NO: 10806 - DNA, 3803 bp, Homo sapiens
tgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 10807 - DNA, 4639 bp, Homo sapiens
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggttaccaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 10808 - DNA, 3061 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 10809 - DNA, 3100 bp, Homo sapiens
gcgcccccaatgtccccaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcc

SEQ ID NO: 10810 - DNA, 3639 bp, Homo sapiens
actttgcacgctcgcagccacgtttccgcacacctgtcccctttccacgcacctgtgtccggcagcccgcacatctgtgggagcgctgcctcctcgccagctgtccgggaagttcagcgccgctctcccacgggcgtgagaccgccccacccacctgtccgtgactgcagctccggccgggagggcggcagcaggtgagaggctgggaggcctcaggtgggaacatacctttggccaaaggcaccaggtaacccgaacgccccggggaggacccctgcctgcatcgccgcggccgtccccccctaccccgtccccagcagctccggctgggcgaggccctgcttctcccttctgctcccgaagaccccccggggcgcagacctggaagcctcgaagctcccgcggccgtccagtccgcccccttctgagcaaccagagagcggtctgggcccggcccggggctgcgcagaggtcagactgccgcgggcagggccggagcctgctctgggggtcgcggaggtgtctcgagagttgaggacccgacccgggcgcgcgcgggcgcaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatccttt

SEQ ID NO: 10811 - DNA, 1663 bp, Homo sapiens
aaatttgtccgctaatggcgcaggcgattatctgcggggcgctgagtgttgtgtgtcctgcgggcagggccggagttacaagcgccaggaatccagacggtgtttggagagggggggcggcgggggagcccggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctag

SEQ ID NO: 10812 - DNA, 562 bp, Homo sapiens
gctaatggcgcaggcgattatctgcggggcgctgagtgttgtgtgtcctgcgggcagggccggagttacaagcgccaggaatccagacggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccct

SEQ ID NO: 10813 - DNA, 2304 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacac

SEQ ID NO: 10814 - DNA, 571 bp, Homo sapiens
cgctaatggcgcaggcgattatctgcggggcgctgagtgttgtgtgtcctgcgggcagggccggagttacaagcgccaggaatccagacggtgtttggagagggggggcggcgggggagcccggtaattagtgtaaaccctttgtctgcctttgatacccacagcttctccccgctgcggcttcctccgcctggagcgcgggcggggagggcctgtggggagggcggccagacccctgatccccgcggcccgggaccggggagggcggtatctcccagttccacgtgttagtgacggcgcccccaatgtccccaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctg

SEQ ID NO: 10815 - DNA, 1475 bp, Homo sapiens
gctcgctccgggagagttgacaaagccccgcagggaaggacgcctcgcggcgcggcgccccgggcccctcgccccgccgccccgggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcaccccactgtcgtggtggccccagatctctgtaattttatgtagagtttgagctgaagccccgtatatttaatttattttgttaaacatgaaagtgc

SEQ ID NO: 10816 - DNA, 3310 bp, Homo sapiens
ttaagatgtctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggagtgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 10817 - DNA, 2810 bp, Homo sapiens
atgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggagtgcgactgcccacccaacttcccccccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcatct

SEQ ID NO: 10818 - DNA, 594 bp, Homo sapiens
atgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggagtgcgactgcccacccaacttccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggagaacctcacggccttgtacctccaacacaatgagatccaggaagtgggcagttccatga

SEQ ID NO: 10819 - DNA, 3949 bp, Homo sapiens
tggcaggtgaggaagcaggcagtgggcgagaagatggattcctttttggacagacaagaccagagagtgaagcgggaataactcatcctccctacctccccagcaaggaaacctctacaaacaggagcagccaagcaggactgaggcccttgccccccaagcatcttctcaaagaagggcatgtgggggcctgacagctcagctgcatgtgtcagcagctccagccccaccatgaacatctgaactcctcagcggggtaatggaccccctcctttcccccggagacacagcctgagtggcaggaatacagagcctttggagagtggctccctctcagctccgtcatgcaagaacactctctgcacccagcccattctgccaagtgacttaaaggaattaaaaaaaaaaaaagccttggtaaacaaaaagggggtaaaagccacgcagaggcccttcagaagaggtggcgggctgcagacaaaagggcaagagttgaaaagggctgtggaggtagcaagcagcagaggccaccctgctcagggctgggtgccaggccacagggcatgcccgacgaacagggagtcggaaccccctcaggccaccctcgggagtcctggggtccagaggggtgtccctgtaccccttgcacacaggaccctcactctgcagggataagccagctgcgcctgcagcctagggtgccaaggaggctgctgattgtggcccacagcctcatctgaacgccaggagaccaggataccgaggcaccggatcccctctctgtgccctggggagccccagtgctgcccagtcaccccagggctgaggtctgcgtccctagtggtgcaaggcctggtaggaccacggggcagggaatgtgagcgccatctgagctcacggtgtcctgagtcgcggcttcgtgactttggcaggggcctccggaccagtgaccccagtcaaacccagagggtcttgggcggcagcgacgaaggaggtattcaggctccaggccaggtggggccggacgcccccagccatccaccatggtggtggcacaccccaccgccactgccaccaccacgcccactgccactgtcacggccaccgttgtgatgaccacggccaccatggacctgcgggactggctgttcctctgctacgggctcatcgccttcctgacggaggtcatcgacagcaccacctgcccctcggtgtgccgctgcgacaacggcttcatctactgcaacgaccggggactcacatccatccccgcagatatccctgatgatgccaccaccctctacctgcagaacaaccagatcaacaacgccggcatcccccaggacctcaagaccaaggtcaacgtgcaggtcatctacctatacgagaatgacctggatgagttccccatcaacctgccccgctccctccgggagctgcacctgcaggacaacaatgtgcgcaccattgccagggactcgctggcccgcatcccgctgctggagaagctgcacctggatgacaactccgtgtccaccgtcagcattgaggaggacgccttcgccgacagcaaacagctcaagctgctcttcctgagccggaaccacctgagcagcatcccctcggggctgccgcacacgctggaggagctgcggctggatgacaaccgcatctccaccatcccgctgcatgccttcaagggcctcaacagcctgcggcgcctggtgctggacggtaacctgctggccaaccagcgcatcgccgacgacaccttcagccgcctacagaacctcacagagctctcgctggtgcgcaattcgctggccgcgccacccctcaacctgcccagcgcccacctgcagaagctctacctgcaggacaatgccatcagccacatcccctacaacacgctggccaagatgcgtgagctggagcggctggacctgtccaacaacaacctgaccacgctgccccgcggcctgttcgacgacctggggaacctggcccagctgctgctcaggaacaacccttggttttgtggctgcaacctcatgtggctgcgggactgggtgaaggcacgggcggccgtggtcaacgtgcggggcctcatgtgccagggccctgagaaggtccggggcatggccatcaaggacattaccagcgagatggacgagtgttttgagacggggccgcagggcggcgtggccaatgcggctgccaagaccacggccagcaaccacgcctctgccaccacgccccagggttccctgtttaccctcaaggccaaaaggccagggctgcgcctccccgactccaacattgactaccccatggccacgggtgatggcgccaagaccctggccatccacgtgaaggccctgacggcagactccatccgcatcacgtggaaggccacgctccccgcctcctctttccggctcagttggctgcgcctgggccacagcccagccgtgggctccatcacggagaccttggtgcagggggacaagacagagtacctgctgacagccctggagcccaagtccacctacatcatctgcatggtcaccatggagaccagcaatgcctacgtagctgatgagacacccgtgtgtgccaaggcagagacagccgacagctatggccctaccaccacactcaaccaggagcagaacgctggccccatggcgagcctgcccctggcgggcatcatcggcggggcagtggctctggtcttcctcttcctggtcctgggggccatctgctggtacgtgcaccaggctggcgagctgctgacccgggagagggcctacaaccggggcagcaggaaaaaggatgactatatggagtcagggaccaagaaggataactccatcctggaaatccgcggccctgggctgcagatgctgcccatcaacccgtaccgcgccaaagaagagtacgtggtccacactatcttcccctccaacggcagcagcctctgcaaggccacacacaccattggctacggcaccacgcggggctaccgggacggcggcatccccgacatagactactcctacacatgatgcccgcccacccgggctgccccgcctcagccccagctgccctggcgtggccatgtggctttgcccagcctgctgcaatccaagagagcaaggaagagaaattccatgggtgactttcctccgcagaaagcaaagtttggggagggctgacgattttgtagaacacaacagtgacaattttttttaaaagaatagaaggcaggagggggaattcgacattgttgaagacataatttataccaagttatgccagttggggagggaaggactaaaaataatattgcaggcagggctgggttgggttttttttttttcccccctgaactggaaggatactacctgtacaacatctgtggacacctcatgctctgttcaaggccatcacaaaggaaccgccagggagaagcagccggctctcaaagctcccacgcagctctcccgccactggccactcgctggcgacccgatggaaggttttcaggctcctcacaaaggagagagggaagaaaagatcttttgccctggagatatggtcctgaaatctctcccctggcttattccataccatttcccttgcagatttgcagaaacatggcatctttcactgcattctttgaacaatcatgtagtcgattaaaaaaaaaaaacaaacttttttttcctaggctgaagccctcttcagttccatgcaccacgctccgtagaagccccggcggaagccgtagctttccctgccacctggaggtgcatctgtctgcctgtctatccctgtcgcggtgtctctaagtacagatgggtagatagagccacatgcacggtccttaccgttcttcttgggtcagttcttaccatttcctgaacaatagaattgtgaaagtgtt

SEQ ID NO: 10820 - DNA, 7943 bp, Homo sapiens
agttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccgtgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtctggtaagaagtattaatgaagtagctaatattacagcttcattttctactagcacctatcataatggtcttagtcatttcacacaaatcagaacttccttccccaccagggaggacaacatcttcatgctgtgattgaagcatccattcagaacacgaggcaatattgcagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaagaaaaccacattgtgtttatctgagtaagttcattgggatacagtcaatacttgtgctgttaatgtagaagaaatgacgcaggagggcaggaataaaagaggtaataggactttcgtattctcctatcatgaatatgacttgcatttctaaaggccatttgatcctttttgtgtgaggagtttatatgaaatcctcatgttcttttaaatttcccaactaaattgtgtgttcctacgaataccttttaggtatgcacacatacacagagcatcttattttatactggtgaaatctatgttgtttaggatacagataatgtcattgtatttatcctatcagaataggcttttcccctatttcaaaatagatgctattggctttattttttatttttaaattttttttaaacacggtcttaccatgttgcccaggctggtctcaaactcctagatgcaagcaatcatcccacctcgatcacccaaagtgctgggagtacaggcagaggacaccatgcccagccacgctattggttttaaatgtcagatttctttaagaattctcatagtacttttctgccgcagaatttatagcacatctgtccatcctttcaataggcactcaaggaaatgtatctattcatatgctcaacttcaattgattagtctcatatgatttttcagaaccccttttgctaacccctcttggccatttcattaataatgtatttgacagagattgaatcaggaaataaattcatgacatttcagttaa

SEQ ID NO: 10821 - DNA, 1557 bp, Homo sapiens
agagcgcgagggacggagggagaggaggagcgcgggagctgcggaggcgatcccgcgaattcattactgtaaacatatccgggggtgtcaggaggggtaggggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaag

SEQ ID NO: 10822 - DNA, 3278 bp, Homo sapiens
catcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcaggtaaaaggggctgcgttgccagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataag

SEQ ID NO: 10823 - DNA, 3971 bp, Homo sapiens
ctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcagggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaa

SEQ ID NO: 10824 - DNA, 4776 bp, Homo sapiens
agtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaacatcttgaggttgtgtatcattttacttcaaagagttcagtgtttcatgtataaatgtatttcctcttacttatacactgtatagatggaaaatttaagaaatggtttcaaagcctttctctcttaggcgcactgctgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatcaagcctccataaaaaaacaaaaggtcaagatttggagagcttccagattgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtctgaagaggaggcagttttgtgggaataagccctcaacctgtgggatatgacacaatttccaggtagacagtgttgggattaaactgaattggaggacacccagctggtatctgctgaagaactgattgcttgcgtggtgtatggggcaaaacttgttaagacaagtcttctatgttgattattgttgaatgagagaattaaacacacatacacactt

SEQ ID NO: 10825 - DNA, 2635 bp, Homo sapiens
agtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgt

SEQ ID NO: 10826 - DNA, 522 bp, Homo sapiens
tgtcacacagataaatatgagtcacaggagtttgttgtacatagtattacatcacccagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagtagcatttggcttggaggagagcccataagtagtgagcacttgcaccgggctgtcagtgtgaatgatgaagatttgctggtccgaatacttcaaggagggtgagagaactctgtcagttgttttttttcccccatgcctataaagtgcatagaaataca

SEQ ID NO: 10827 - DNA, 949 bp, Homo sapiens
gttccttcttccacatgtatccctcagtatctagaaccctgaaattggtttctctaagaaaaccaagaggcccataaggaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagtagcatttggcttggaggagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatgagtgtagtctccttattagaagaaaggaaaaaaaagcagaggccaaagaagtcttgtgtctgctgatgagagcaccactcat

SEQ ID NO: 10828 - DNA, 1268 bp, Homo sapiens
ttacagaagcaaaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccaggccatctctgagcaagagccttgtaaaaattaggatggtcacaagtgttctccacggcccacccactgaaaacacaggagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacct

SEQ ID NO: 10829 - DNA, 1294 bp, Homo sapiens
cacttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacct

SEQ ID NO: 10830 - DNA, 1296 bp, Homo sapiens
cacttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaa

SEQ ID NO: 10831 - DNA, 499 bp, Homo sapiens
tgggctgtgaaaaaaatcatttgttcaacactgatgtcgtgatacaaggacgtgaagatgtgagtcattgtgacatcaccagccagaattgctgggattcagtgagatgactcacagtaagagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatact

SEQ ID NO: 10832 - DNA, 672 bp, Homo sapiens
agtgtctggttcagtagttccttcttccacatgtatccctcagtatctagaaccctgaaattggtttctctaagaaaaccaagaggcccataagggtaatgtatactgttgatttttatggttatttttcaaaaactaatattttaaacatatcaaaattatttcaaatggtaatgtactcaatgtaccatttggtttaagatgttaacattttgccatatatgtcataaagtcttttcatgaagaaatcaaaccttacaaatatactgaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagtagcatttggcttggaggagagcccataagtagtgagcacttgcaccgggctgtcagtgtgaatgatgaagatttgctggtccgaatacttcaaggagg

SEQ ID NO: 10833 - DNA, 1283 bp, Homo sapiens
gttcgcccgcggaggccggggagcagccgaccatggagccccagatgggctgtgaaaaaaatcatttgttcaacactgatgtcgtgatacaaggacgtgaagatgtgagtcattgtgacatcaccagccagaattgctgggattcagtgagatgactcacagtaagagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagtgagtattcagaccgtccacactcacctctctctagatcaatggagatgacaagcaatttagaaaaaatattctgcctctcgtttggccttaccagaagcagaaatgatacaatttttaaacactgcaataatatttgctagttgggccttgccataacttgtaatgtcagggaagtctaattatgctttcacaaactgggagagctatttttgtgccagaactgtcctgttagtagccattcagcacaaaagggtggagtcacctttcttaggaaatgggccacaggggtgtgggctgggtaagcctaagcgtccccacacagccaagcaggctgcctgcctgagcgtccttgggcaagcagctccattcagtgtcatatccattttagacaaccccagggtgtgcgtcttaactcgccacacaaacccgattcctggggtcacggtgagtgagggtgaacgaacagtgctgctgcatccacggagaatcctgtgagggagagccccacatggagacctctgagcccttcagccggctgagttttaaggttgtttctgagattggtattttaaagcattttaaagatgctatctatgtccagggccatctctgagcaagagccttgtaaaaattaggatggtcacaagtgttctccacggcccacccactgaaaacacaggcaagtaatttttcagttgcacaaaggaaaccttccttttgtgagtaaagctctttttccgttttattccaggtagcatttggcttggaggtatgtgctttccatggctttcaactgtgtcctttaggca

SEQ ID NO: 10834 - DNA, 753 bp, Homo sapiens
gagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatgagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaa

SEQ ID NO: 10835 - DNA, 1847 bp, Homo sapiens
ctgcgcaatgcgcgcggtgatggagcgctaaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgtacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacactggccaggcgaggc

SEQ ID NO: 10836 - DNA, 7623 bp, Homo sapiens
gcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggtaaccctaaggcctggggagaaaagcttttaaatcttgccttctttcttctgtactttgtctttttaaaatctcattactatctattatttagttctaacacagaagctttaaaaatacatagtcatccaaggttttctaaaaattgaaatcatatgttgggaatggtaaaaaggttttcaaatggtttatttttcctcttttataaataagttttacaaaattttcctcttttgtttattgactagattgtatataattttcttttttccaaaatattgtgataagaaatttctagacacaacagcttaaaatcacccaaatttcagttctttacctactgcactaacaatggcaaggggggtattctttatatgttgccttgtttaactacagttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaagaaggataggttataaagggaggtacctaaatactcaaataatgtatatattctttttcataacatatggaatgctttaagcaattgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactgcccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttatctatatactttgtccataaaattataattgtttatgtaattttattgtttcttatggaaacaattggaaaagtatatggaaaatgattatttcaaagaatatttatttaaagagggaagtgtagacttcttactgtaaaatatgtgattccaggcttaagaaattgattatattttaaaataattatttttttaaaaacgtaatttgtttttaaaagatgagtctccattcattggctaatccatacagcaaatatttgagtgtttgtgatatggcagtaaaaatgtgattactttgtatgtacattaaccaaaaccagtgaagtttgatggactgtgcatagagttttgcagcttttgagtagtgtgacagagtttgcctcttaaaattgttttgctaataagtcagaagtttaaaatgtgttatagtttgctaaaaaaaaatcaaattaactgcatataaaatggttcacttttatatagtcacatgtaatgggcctgaaaaagtttcttctttgattatgtagttactctagatacattcttttagggaagtgtatggtcaacatatatttactcagtatacagataaccacaaagttgttatttttaaccaaaatatacatttcataatgttggcactggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctctcctgacatatttgttttgctttaaattggattaaatggtttacaggttatctgaatctacagatttagtatgtctattatctggacatgattttgctatgcagttgtgataataaaaattctaattcctcaggtttggccttttaagttatggctgaagacctttaatgatacttatgatgcactcagtgccatacaatagtgttttaagaagcacatggcctcattttccttagaaacaagacaaagcctttttaaaatgtttttttttcactttaaaatagggtattcaaagtggagtaacgtgtattttgaaatgattttgtgttctatatagaatgtcccagttaagattttacagaagcacctggaatatctcattaaaaatttaaaaactctt

SEQ ID NO: 10837 - DNA, 658 bp, Homo sapiens
ctttcaccctggcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggtacacaaaaactgcattaatacacttaacaagggaagttgtatttttaaaaaggcgtttttgtttttctttagttttggatttctttactgatttctaatactaataaagccttggggtttcttg

SEQ ID NO: 10838 - DNA, 1804 bp, Homo sapiens
ggtgccggtgcgggctggggcagtgcagtgagtagcggtcttggggtgtgcgatctcgctgagcctcctcacacggttcgtcgtctcgggttcgagcccagtgggcttagccactcgccatggactcccagaaatactgctttaaggagaatgaaaacgttacagttgataaagcctgttttctgatctctaacatcactattggaccagagtctattaacttgcagcaggaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatca

SEQ ID NO: 10839 - DNA, 1944 bp, Homo sapiens
agtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagtgtccatgttacttcactgaagaaacatacaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggt

SEQ ID NO: 10840 - DNA, 6552 bp, Homo sapiens
ctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcagttgaccacccactgaagccaaggcatgtgaaactgctgtccactaaaatgggcctgaaagtcacgtgggacccacccaaagatgctaccagtagacctgtggagcattacaacattgcctatgggaagtcactgaaaagtcttaaatacatcaaggtgaatgcggagacatactccttccttattgaggatgtggagccgggggtagtgtactttgtgctgcttactgcagaaaaccacagtggagtgagccgtcctgtttacagagctgaaagcccacctggaggtgaatggatcgagattgatggttttcccattaagggtccaggaccatttaatgaaaccgtcacagaaaaggaagtgcccaacaagcccttgcgtgtgcgtgtccggtcctcagatgacaggctgtccgttgcgtggaaggcaccacgcctgtctggagccaagagtccacgcagatcacggggttttctcctgggctacggggagagtggccggaagatgaattatgttccactgacaagagatgaacggacacacgaaattaaaaagctagcctcggaatccgtgtatgtggtctccctgcagtccatgaactctcagggccggagccaaccagtctacagggctgccctaacaaagcgaaagatttcagaagaggacgaattggatgtacctgacgacatcagcgtccgggttatgtcatctcagtctgtgcttgtgtcctgggtggatcctgttctggaaaaacagaagaaagttgttgcatcaagacagtacaccgtgcgctatcgagagaagggggaattggccaggtgggattataagcagatcgctaacaggcgtgtgctgattgagaacctgattccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaaccagtaaggcggatgttgagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcccggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccgcccgcagcacggtcacagcagcatcccagtgttcccagaaggatgacacccggccgggccccacaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggtggagtctcccacaggcgcaggggcaggtggcgaccacaggtcccagcgcggacatgcggcctcccccgccaggcccagccgacccggcggcccccagtcccgcgcccgggtacccagcagggcagcgccggggaagtcggagcctccttccaagcggcccctgtcctccaagtcccagcagtcggtctcagccgaggacgacgaggaggaggacgcgggattttttaaaggcgggaaagaagaccttctgtcttcctctgtgccaaagtggccctcttcctccactcccaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgactgccgcctcgcagcgctgccaccgtgagccccgtcgcgggcacccacccctggccgcagtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccacccgccgcacgaccaccaggcgtccaacaaccacagtccgaaccactacgcggacaaccaccaccaccacccccacacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgacctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtggggtctccatccctggaaagtggtaatcacaggaccgtcatgctgcaagcttgccctgcccagccccaccaactaagtcgcactaggggctgtgagcaaagacagccagcgtgctcagccccgctgccctaggtgccaggaaggtcatagatggacactggccattctggtcatctcagtctggaactcagtcccacttcttggcctggacaatgaacaggattcagttttgctgttaactttgcttctctacttttttttgtttgtttgtaatagcacatcccagagacatcagaaaccagcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcaccagat

SEQ ID NO: 10841 - DNA, 6359 bp, Homo sapiens
ctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcagttgaccacccactgaagccaaggcatgtgaaactgctgtccactaaaatgggcctgaaagtcacgtgggacccacccaaagatgctaccagtagacctgtggagcattacaacattgcctatgggaagtcactgaaaagtcttaaatacatcaaggtgaatgcggagacatactccttccttattgaggatgtggagccgggggtagtgtactttgtgctgcttactgcagaaaaccacagtggagtgagccgtcctgtttacagagctgaaagcccacctggaggtgaatggatcgagattgatggttttcccattaagggtccaggaccatttaatgaaaccgtcacagaaaaggaagtgcccaacaagcccttgcgtgtgcgtgtccggtcctcagatgacaggctgtccgttgcgtggaaggcaccacgcctgtctggagccaagagtccacgcagatcacggggttttctcctgggctacggggagagtggccggaagatgaattatgttccactgacaagagatgaacggacacacgaaattaaaaagctagcctcggaatccgtgtatgtggtctccctgcagtccatgaactctcagggccggagccaaccagtctacagggctgccctaacaaagcgaaagatttcagaagaggacgaattggatgtacctgacgacatcagcgtccgggttatgtcatctcagtctgtgcttgtgtcctgggtggatcctgttctggaaaaacagaagaaagttgttgcatcaagacagtacaccgtgcgctatcgagagaagggggaattggccaggtgggattataagcagatcgctaacaggcgtgtgctgattgagaacctgattccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagccagtaaggcggatgttgagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcccggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccgcccgcagcacggtcacagcagcatcccagtgttcccagaaggatgacacccggccgggccccacaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggtggagtctcccacaggcgcaggggcaggtggcgaccacaggtcccagcgcggacatgcggcctcccccgccaggcccagccgacccggcggcccccagtcccgcgcccgggtacccagcagggcagcgccggggaagtcggagcctccttccaagcggcccctgtcctccaagtcccagcagtcggtctcagccgaggacgacgaggaggaggacgcgggattttttaaaggcgggaaagaagaccttctgtcttcctctgtgccaaagtggccctcttcctccactcccaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgactgccgcctcgcagcgctgccaccgtgagccccgtcgcgggcacccacccctggccgcagtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccacccgccgcacgaccaccaggcgtccaacaaccacagtccgaaccactacgcggacaaccaccaccaccacccccacacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgacctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtggggtctccatccctggaaagtggtaatcacaggaccgtcatgctgcaagcttgccctgcccagccccaccaactaagtcgcactaggggctgtgagcaaagacagccagcgtgctcagccccgctgccctaggtgccaggaaggtcatagatggacactggccattctggtcatctcagtctggaactcagtcccacttcttggcctggacaatgaacaggattcagttttgctgttaactttgcttctctacttttttttgtttgtttgtaatagcacatcccagagacatcagaaaccagcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcacc

SEQ ID NO: 10842 - DNA, 7904 bp, Homo sapiens
aagctcgggcgggggagcggggcgcggcgggaaggagcgggcgacccggtgtgtgggccagcggagctccggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaatagggtttttctgccatgactaggattgcttttgttgttgttgttgttgtttctttctttttttttttttttgagacggagtcttgctctgtcgccaggctggagtgcagtggcgcgatctcagctcactgcaacctccagctcccaggttcaagtgattcccctgcctcagcctcccaagtagctggggattacaggcactcgccaccatgcccggataattttttttttttttttgagttggagtcttgctctgtcgcccaggctggagtgcagtgacccaatctcggctcactgcaagctccacctcccgggttcatgccattctcctgcctcagcctcccaagtagctgggactacaggtgcccgccaccacgcccggctaatttttttaattttagtagagtcggggtttcaccatgttggccaagatggtctcgatctgacctcgtgatctgcccgcctcggcctcccaaagtgctgggattacaggtgtgagcccccgcacccagccttattcttcccttttaaatacttaaagcacattcagattagttgaaaattcacgtgtttttggaggccaggcaggtggccttctgcagagacagcagcagctcagctcttgctgaccaaggccttggaggactgtgagccacaatcacatatgtccatgtttcaaaagaagctaaatatccagatttcctccatgggccaactaaaaggtgattgtggactatacaggctgccagtttaatcctttatcagagtctctgtggataatgtaccttgttgcctaatactttatctgtctaccaaaactcagtccagatctccctctgttcacctggcacactgggtgcttcctctcccctgacgaactctatagagtgttcatgtcctttcctgcaggtctcattcaacaacaacaacaacaacagcaataaaacacagtgttcctgcta

SEQ ID NO: 10843 - DNA, 388 bp, Homo sapiens
gcggcggcggcggctggaggaggagagcggcggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagaagtaaatgttaaaaggcactgtttatga

SEQ ID NO: 10844 - DNA, 5083 bp, Homo sapiens
gcggcggcggcggctggaggaggagagcggcggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggg

SEQ ID NO: 10845 - DNA, 3684 bp, Homo sapiens
agtgtctaccaccaaactcctaaggctggatggtggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaa

SEQ ID NO: 10846 - DNA, 678 bp, Homo sapiens
agcagacactggaatgtgaatgcattgggaggtgagcccttaaggagagcccaaatgtttaccaaagagaaaatctggtcagaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcgga

SEQ ID NO: 10847 - DNA, 1657 bp, Homo sapiens
cgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactgga

SEQ ID NO: 10848 - DNA, 2938 bp, Homo sapiens
ataacagagactaaagaagaaagacgcttactgaataaggtgggatccaacaagagtgtagtatggaatgcaatagcttatgaattactttttttctgagggagctcaacagaatgacacctaagaaagggaaagtctttgacacttggtacgtttgtgatttttggtcattacttgaaaattaataagtttgaaatcactactcttagaaatggaagaaagtgatgactctaatcagcctatctcagcgtgtaggcaagaaattcgaaagagaagatgacccagcaaaccaatggtaggcaaatcccagcaaactgatgtaatagagaaaaagaaacacatggccataccaaaatcatctagccccaaagctacccatcgtattggtaatacttctggaagcaaaggcagctactctgccaaagcctatgagtctattagagtatcttctgagcttcagcaaacttggacaaagagaaagcatggacaggaaatgactagtaagtctctccagacagacaccattgtagaagagaaaaaagaagtcaagttagttgaggaaaccgtggtacctgaagaaaagtcagctgatgttagagaagctgctattgaattgccagagagtgttcaggatgtagaaattccaccaaacataccttcagttcaactaaaaatggacagatctcagcagaccagccgtacaggatactggaccatgatgaacatcccccctgtagaaaaagtggacaaggaacaacagacatactttagtgaatcagaaatagtggttatttccaggccagatagttcttctacaaagtcaaaggaagatgccctgaaacataaatcgtcgggaaagatttttgctagtgaacaccctgaatttcaaccagcaacaaacagcaatgaagaaattgggcagaaaaatatcagcagaacttcatttactcaggagactaaaaaaggtcccccggtacttttagaagatgagcttagggaagaagtaactgtacctgttgtacaagaaggttctgctgttaaaaaagtggcttctgctgaaatagagcctccatcaacagaaaaattcccagctaaaatacagcctccattagttgaagaggccactgctaaagcggagcccagacctgctgaagagacccatgtccaagtacagccatcaactgaagagactcctgatgctgaggcagccactgcagttgcggagaattctgttaaagttcagcctccacctgctgaagaggcccctttagtggagtttcctgctgaaattcagcctccatcagctgaagagtctccttctgtagagcttctggctgaaattctgcctccatcagctgaagagtccccttcagaagagcctcctgctgaaattctgcctccaccagctgaaaagtctccttcagtagagcttcttggtgaaattcggtctccctcagcacaaaaggctcccattgaagtacagcctttaccagctgagggcgcccttgaagaggccccagctaaagtagagcctcccactgttgaagagacccttgctgatgttcagcctctattacctgaagaggctcctagagaagaggctcgagaacttcagctttcaacagctatggagacccctgcagaagaggctcctactgaatttcagtctccattacctaaagagaccactgcagaagaggcctctgctgaaattcagcttctagcagctacggagcctcctgcagatgaaactcctgccgaagctcggtctccactatctgaggagacttctgcagaagaggctcatgctgaagttcaatctccattagctgaagagaccactgcagaagaggcctctgctgaaattcagcttctagcagctatagaggctcctgcagatgaaactcctgctgaagctcagtctccactatctgaggagacttctgcagaagaggctcctgctgaagttcagtctccatcagctaagggagtttctatagaagaggcccctcttgagcttcagcctccatcaggtgaagagaccactgcagaagaggcctctgctgcaattcagcttctagcagctacagaggcttctgcagaagaggctcctgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccctgctgaagttcagtctctaccagctgaggagactcctatagaagagacccttgctgcagtacactctcccccagctgatgatgtccctgcagaagaggcctccgttgacaaacattccccaccagctgatttgcttctgactgaggagtttcctataggagaggcctctgctgaagtttcacctccaccatctgaacaaacccctgaagatgaggctctggtagagaatgtgtctacagaatttcagtcaccgcaggtggcaggaattccagcagtaaaattaggatcggttgttttggaaggtgaagcaaaatttgaagaggtttcaaaaatcaattctgtccttaaagatttgtctaataccaatgatggacaggctcccactcttgaaatagaaagtgtttttcatatagaattaaaacaacgtcctcctgaactgtagtcaggttgtacctaagctagcaatcagaagctacatggttttggaagaacatactttagaaaagggtgggcagcgggaagtagctttgtcaataaggcaaattaaaggggaccccaagacttggaatacaggttggaaaatgaacaataaaaactgtagcagcataaa

SEQ ID NO: 10849 - DNA, 2157 bp, Homo sapiens
atggtaggcaaatcccagcaaactgatgtaatagagaaaaagaaacacatggccataccaaaatcatctagccccaaagctacccatcgtattggtaatacttctggaagcaaaggcagctactctgccaaagcctatgagtctattagagtatcttctgagcttcagcaaacttggacaaagagaaagcatggacaggaaatgactagtaagtctctccagacagacaccattgtagaagagaaaaaagaagtcaagttagttgaggaaaccgtggtacctgaagaaaagtcagctgatgttagagaagctgctattgaattgccagagagtgttcaggatgtagaaattccaccaaacataccttcagttcaactaaaaatggacagatctcagcagaccagccgtacaggatactggaccatgatgaacatcccccctgtagaaaaagtggacaaggaacaacagacatactttagtgaatcagaaatagtggttatttccaggccagatagttcttctacaaagtcaaaggaagatgccctgaaacataaatcgtcgggaaagatttttgctagtgaacaccctgaatttcaaccagcaacaaacagcaatgaagaaattgggcagaaaaatatcagcagaacttcatttactcaggagactaaaaaaggtcccccggtacttttagaagatgagcttagggaagaagtaactgtacctgttgtacaagaaggttctgctgttaaaaaagtggcttctgctgaaatagagcctccatcaacagaaaaattcccagctaaaatacagcctccattagttgaagaggccactgctaaagcggagcccagacctgctgaagagacccatgtccaagtacagccatcaactgaagagactcctgatgctgaggcagccactgcagttgcggagaattctgttaaagttcagcctccacctgctgaagaggcccctttagtggagtttcctgctgaaattcagcctccatcagctgaagagtctccttctgtagagcttctggctgaaattctgcctccatcagctgaagagtccccttcagaagagcctcctgctgaaattctgcctccaccagctgaaaagtctccttcagtagagcttcttggtgaaattcggtctccctcagcacaaaaggctcccattgaagtacagcctttaccagctgagggcgcccttgaagaggccccagctaaagtagagcctcccactgttgaagagacccttgctgatgttcagcctctattacctgaagaggctcctagagaagaggctcgagaacttcagctttcaacagctatggagacccctgcagaagaggctcctactgaatttcagtctccattacctaaagagaccactgcagaagaggcctctgctgaaattcagcttctagcagctacggagacttctgcagaagaggctcctgctgaagttcagtctccatcagcagaagaggctcctgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccctgctgaagttcagtctctaccagctgaggagactcctatagaagagacccttgctgcagtacactctcccccagctgatgatgtccctgcagaagaggcctccgttgacaaacattccccaccagctgatttgcttctgactgaggagtttcctataggagaggcctctgctgaagtttcacctccaccatctgaacaaacccctgaagatgaggctctggtagagaatgtgtctacagaatttcagtcaccgcaggtggcaggaattccagcagtaaaattaggatcggttgttttggaaggtgaagcaaaatttgaagaggtttcaaaaatcaattctgtccttaaagatttgtctaataccaatgatggacaggctcccactcttgaaatagaaagtgtttttcatatagaattaaaacaacgtcctcctgaactgtag

SEQ ID NO: 10850 - DNA, 2251 bp, Homo sapiens
gttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 10851 - DNA, 2896 bp, Homo sapiens
ccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctga

SEQ ID NO: 10852 - DNA, 2348 bp, Homo sapiens
cccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggccc

SEQ ID NO: 10853 - DNA, 2947 bp, Homo sapiens
ctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgcagaaatccaagaagggaaggcagaacaccccagcgggatcaagtaaagaggactgcagggttcttccatggaagcaggggttggaggatacccaccttgatgcctatctcccatgttgcaggagattcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctg

SEQ ID NO: 10854 - DNA, 2355 bp, Homo sapiens
gttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcagagccgtggggttggcctcactgtgccaggacctgaatggggcgtgggcagtatggaaagtgggaagagcatcccaggccgagggaacagccagcgcaagagcccagaggagagggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcc

SEQ ID NO: 10855 - DNA, 568 bp, Homo sapiens
atgaattcctatacaagaggctcccgcaggcccagcgccaaagctgcctcccctgcagcctcggtgacttcccgggtctctccctccggccctggtgtcccggtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgag

SEQ ID NO: 10856 - DNA, 572 bp, Homo sapiens
gcgctgctggcggccggaggtaggggcgtcccgggtccgccgccccagcttagggtcccgaccccctcggcctcgcgctccctgcgagtttcggaaccacggggactcggagtccgtgcgttgccctgcgcggcgcccccggactgtcagcgccgaggcctcggcgacgcccccctcccccacggccagctccggtcctcatctcctccccggcctggggacttgtttcaaaaccggattcccccacccctcaaacacaccgtcctaccccagtcctagcaaatccagccggctccgggggccgcatcccgggccctgggggttcaggggcgctagctgggctgggggacgctggctgggggttaccgagcccagggcgccttgcacttgacgctggaagcgccctcggctatctttcctcaccgcttcccgcctccacccccagtggacgcggatgtcctcctggaggcctgctgtgcggacggacaccggatggccactcatcagaaggactgctcgctgccatatgctacggaatccaaagaatgcaggatggtgcaggagcagtgctg

SEQ ID NO: 10857 - DNA, 2531 bp, Homo sapiens
ccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgcacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatgg

SEQ ID NO: 10858 - DNA, 512 bp, Homo sapiens
aaagctgcctcccctgcagcctcggtgacttcccgggtctctccctccggccctggtgtcccgggtgagcccagcacacgttgggattttggttgtttgttggcctggcccgactgtccctgtctctgagggcagagtcgggtcccatcccgggacacgcctggggttagccaccgacctgcagcctcccggccgagggtgcggggttggcgtcctgtcctcaccagacttctcacaggtccccgtttctgtggaagaggggatcttgtgtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaag

SEQ ID NO: 10859 - DNA, 544 bp, Homo sapiens
tgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacgggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaag

SEQ ID NO: 10860 - DNA, 565 bp, Homo sapiens
tcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgag

SEQ ID NO: 10861 - DNA, 671 bp, Homo sapiens
ccgcgccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacgggaggcgggccctgcaagcagcagtgccgagaca

SEQ ID NO: 10862 - DNA, 4127 bp, Homo sapiens
ggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttta

SEQ ID NO: 10863 - DNA, 4318 bp, Homo sapiens
agccaggggccgcccgggctctcgacgcgccgacggccgggcggacggacggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtggacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttta

SEQ ID NO: 10864 - DNA, 584 bp, Homo sapiens
acacatacacgccccattgggagcagctgtggagatgtgaggacagtgaggtctgctattctcccagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggc

SEQ ID NO: 10865 - DNA, 4193 bp, Homo sapiens
gattcccttcatttatttcatcatggggctcatgcctgcctggcgttcagttctctacagatttgctcttgggtttattatctgcccctccacccctgagggtgtcagtgctgtgaggacgctgggaacctgtcttgctggctgataaacccctggttcctagaggggctgggtgcagaggaggcgttcctttagaaatggggcaggcttggggaccactgctgtggtaacgagtcctgctgtccctctgtcactgccctatggggctgcgctttaggctgggagtcggagaaggagctcttgcctgtgactttggggagcacgctgtctataagagtcagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtggacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgc

SEQ ID NO: 10866 - DNA, 3873 bp, Homo sapiens
agacaccgagaccaagagcttggccggggctgtggggcgaagcttcctgggcccttggtggggatgagctgggggggcctctggggaggggagttaatgatcctgggcacgaggccggtggccactgggacatagtcaccgagggtgatggagacttcccttagcctggagagtggccatcatgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataact

SEQ ID NO: 10867 - DNA, 2123 bp, Homo sapiens
gccacgcagcgcgggcgtgcacgcccctccccgccgggccgcgctgccagccccgccccgcccctgggtgggaaggtcaaggggcccgggccctcccagcccccgcacccctgcgcgcgcccgcccctcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcattgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcag

SEQ ID NO: 10868 - DNA, 547 bp, Homo sapiens
ccttcttcgggaagatcgcgactctcccgtcgctcgccccaagcctctgcttcagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccg

SEQ ID NO: 10869 - DNA, 2299 bp, Homo sapiens
cttagcccaggggccggcgcctccccgcctcgcgcggactgtctcgtgcgggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccaggacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcgttgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctccttcc

SEQ ID NO: 10870 - DNA, 1394 bp, Homo sapiens
catcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcgtt

SEQ ID NO: 10871 - DNA, 1057 bp, Homo sapiens
accagaagagatggagctggacagagctgtgggggtcctgggcgctgccaccctgctgctctctttcctgggcatggcctgggctctccaggcggcagacacctgtccagaggtgaagatggtgggcctggagggctctgacaagctcaccattctccgaggctgtccggggctgcctggggcccctgggcccaagggagaggcaggcaccaatggaaagagaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggttgggagcttggccctacggtttgtaaaagaaacacatgtcgtgattct

SEQ ID NO: 10872 - DNA, 1505 bp, Homo sapiens
aaagaccagaagagatggagctggacagagctgtgggggtcctgggcgctgccaccctgctgctctctttcctgggcatggcctgggctctccaggcggcagacacctgtccaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggttgggagcttggccctacggtttgtaaaagaaacacatgtcgtgattctaaattgggtttgtcttgctgtgcggaagaggttcaaatccagctctgtttccgcaatcaaccctttcagatttgtgacattaactcacctcaaacctctgtctttccttgacaatgagtaagaatgtgttcctgaccatgccagcaggaaccttccttaaggacaaatacaagactttgaagctgcgatgggctcagagtgcagccctgctcaggtccctgggcaggctaaacgccttcctggggctcgaccatctgggcttctctgtgagctggatggcagggaagtcagaaggcacattggagaggaagtttctcttgcactcagagatgccgttgcctgtccaaggcccccagcctcgtagccgcagctctgctcactctcccccgtcacccaggcttcctgccgcctgctgtcctgggtattcgtgggatctgctcgctacttcctcacaagccgaagcaagagtggcagtgtgcctgtgactccctcatcaaaacggagagagtggttacatgaggcaggtgtgagggacccgagcactcctgaggagggaag

SEQ ID NO: 10873 - DNA, 1240 bp, Homo sapiens
ggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaatgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccaaggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggac

SEQ ID NO: 10874 - DNA, 1286 bp, Homo sapiens
cagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaatgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccaaggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaag

SEQ ID NO: 10875 - DNA, 4369 bp, Homo sapiens
gagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagccagacacactcccatgacgcccacagctgcccctttgcccccagctcagtcaagccgccacatgcccacaacctcaccagagggagaattatgtttctaaatatgtttactttgggacagaaaagttttaccagtttcaatgtgtgtttcttgaacaccagtggttttgatcactttcctgtgtctgttgcacggcaggtctttccctggaatttggtaagtcgggaagagtcaggacccttatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaacgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctggggttctggcaatgctctgtttcttgacccaggtggtgattgtaaggatgtttgttaactagtgatgaaaataattaagctgtacttttgctttatacacttttgagtacatgttatgttccacaatttaaaaactacttataaagaaactgcacatgcttggatccaggaacatgagctacaggcacatcctccactgatgcccagtgttcttgactcaatacctgtaaggagaggtccttgtagcccattgggggctgaccagaccctactacgcccctgccacaatctctagtccatcacaaaatccactattgggatagtactttcgtccctcagtaggtaagcatttttacaacctaggaagacttagctttaagtctagaaatgattagtataaatataaaatataaatatgattaatataaatataaaatagccatagaaatatgccttttagtttgttttttgagacagagttttactctgccacccaggctggagtgcagtggcgtgatctcagctcactgcaatctccacctcccaggttcaagagattctcatgcttcagcctcccaagtagctgggatcacaggcacacacaaccatgcccagcaatttttttgtatttttagtagagatggggtttcgccgtgttggccaggctggtcttgaactcccgacctcaagtgatccacccgcctctgcctcccaaattgctgagattacaggcgtgagacactgtgcctggccaaaatatgccttttgtattaaggaatctggacaggtttgatttttcacagtcttgtaatgtttaaataatttggcctattatgaagaatctcacaaatccaatataaaatgtggaactaactaatcaaaatcatcttgtaatattacatggaaatcttagtgcgtttatacacggtattggcatatttaagagactttgagctcattgcatttctaagttaaattattagatttcttaagatttaagttaaattattagatttttaaagattaattagtgctaaggagggttttctcattagacagctgaaatgccgcaggagaaatttgagtgtattccacttcttattgcaattttaaatgtttgaagttatttaaagaactaaatttatggtatccaaaagctctaaaaaggtgactcttaagatttgcaggtcttataaatagaaaaacaagaactgtaagccaaacttaaaatattcaggatgaattgagtttttgaatttgtagctttcagaaactgaacattaattttaagaagcaaagcaggctgggcacagtggctcacgcctgtaatcctagcactttaggaggctgaagtgggtggatcacttgagatcaggagttcaagaccagcctggccaacatgatgaaacctcctctctactaaaaatacaaaactccgccagaaatcgcttgatcccgggaggtggaggttgcagtgagctgagatcgtgccactgcactccagcctggggaacagagcgagattccgcctcaaaaaaaaaataaaaataaaaagaagaagaagaagaaggagaaagagggagagggagagggagagggagagggagagggagagggagaagaagaagaagaagaagaagaagaagaagaag

SEQ ID NO: 10876 - DNA, 1030 bp, Homo sapiens
agcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggagatccagtgaacctgctccggtgccaggaaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttc

SEQ ID NO: 10877 - DNA, 997 bp, Homo sapiens
agcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttc

SEQ ID NO: 10878 - DNA, 931 bp, Homo sapiens
gaagggcctgggtaccctatgatggccctcctacagggtatggaaggctgggaggagtgggaaggattcggaaaagggcctgggtaccggctccactggtggctcagcgctggggtgctgagacatcagagccaacactcatcccttctctggggcaggagatccagtgaacctgctccggtgccaggaaggtgaggcagcccttgcaggagccaggaacttgggatcacatggtgttgggtgttggcagacccccaagtgtggccaagatcctccccacagcctcctcagaacccttcttcagggacctgaaggagccaagagggtccctagggtcccacacttgttccagtgcctgggggtgggggtcagggaataacctgggcaccaccccagtccatctcccctttcccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggtgagtgagcctaaggggagcagaggaaggaggctggatcctttcccagtgctgccactgcccccatgaatgacccagggcaatcctgtctcctctgtgggccttagtttccgcatctgagaa

SEQ ID NO: 10879 - DNA, 3011 bp, Homo sapiens
agtgcctaatgggtgttgttcctggctggacttgatgtccagggcctgaggggttttctcgccgagtctcctggggcggtccggaggctcgtgccctgttgtggggcccccatttgccgccgccatgcccacggccgccgcccccatcatcagctcggtccagaagctggttctgtatgagactagagctagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaaagctgttgatctatggacgaccagtgtatgtcactctaatagctagaagatccagtaaatttgctggcacccgttttcttaaaagaggtgcaaactgtgagggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacattggatcaggcagatccatttgcacatgtggctgcccttcactttgaccagatgttccagaggtttggctctcccatcatcatcttgaatttagtgaaggaacgagagaaaagaaagcatgaaagaattctgagtgaagaacttgttgctgctgtgacctatctcaaccaatttttgcctcctgagcacactattgtttatattccctgggacatggccaagtataccaaaagcaagctgtgtaatgttcttgatcgactaaatgtgattgcagaaagtgtggtgaagaaaacaggtttctttgtaaaccgccctgattcttactgtagcattttgcggccagatgaaaagtggaatgaactaggaggatgtgtgattcccactggtcgcctgcagactggcatccttcgaaccaactgtgtggactgtttagatcgcaccaacacagcacagtttatggtgggaaaatgtgctctggcctatcagctgtattcactgggactgattgacaaacctaatctacagtttgatacagatgcagttaggttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagatttgttcagctggggcagagtcaacataaacaagacaagaatagccagcagccctgttctaggtgctcagatggagttataaaactaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatt

SEQ ID NO: 10880 - DNA, 791 bp, Homo sapiens
caaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcgggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacatgtgtgtggagccatgtttttaataataactcctgtcctcacatttagagataatgaactgttgtcacagaaatctcataaatgcttaggttttcaggaggttttagtcctggaaggtagataatttagaagaggaatttccgttattcttatgtaataaatttatgtttaattttgactgttaaataaattatttttattttgcttca

SEQ ID NO: 10881 - DNA, 439 bp, Homo sapiens
gttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagggttcctagcaagatctcctgcgaatctggaatgctccaattgaggactccatctagtcatgcttcagcatccc

SEQ ID NO: 10882 - DNA, 724 bp, Homo sapiens
gagcaaaaaggaatttaaagaacctcctctaaataactgcctgctcccattggacttcctgaggccctcctggctccttagagcttgttgaactcagctttgcattgtattttctatgcatctatctcatctcctttctaactgtgtaagtgttggaggcaggagcttaccctcggtcagggctgtatcccccacagagcttatcacagtgctgtctgtgaacacagttaatattatggaaatgtttgcttgctataatctcagacttttagagtaacatgcagtatctctcttagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgag

SEQ ID NO: 10883 - DNA, 2262 bp, Homo sapiens
gatcatctataggtttagtgcctaatgggtgttgttcctggctggacttgatgtccagggcctgaggggttttctcgccgagtctcctggggcggtccggaggctcgtgccctgttgtggggcccccatttgccgccgccatgcccacggccgccgcccccatcatcagctcggtccagaagctggttctgtatgagactagagctagatactttctagttgggagcaataatgcagaaacgaaatatcgtgtcttgaagattgatagaacagaaccaaaagatttggtcataattgatgacagggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcgtggatcaggcagatccatttgcacatgtggctgcccttcactttgaccagatgttccagaggtttggctctcccatcatcatcttgaatttagtgaaggaacgagagaaaagaaagcatgaaagaattctgagtgaagaacttgttgctgctgtgacctatctcaaccaatttttgcctcctgagcacactattgtttatattccctgggacatggccaagtataccaaaagcaagctgtgtaatgttcttgatcgactaaatgtgattgcagaaagtgtggtgaagaaaacaggtttctttgtaaaccgccctgattcttactgtagcattttgcggccagatgaaaagtggaatgaactaggaggatgtgtgattcccactggtcgcctgcagactggcatccttcgaaccaactgtgtggactgtttagatcgcaccaacacagcacagtttatggtgggaaaatgtgctctggcctatcagctgtattcactgggactgattgacaaacctaatctacagtttgatacagatgcagttaggttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagat

SEQ ID NO: 10884 - DNA, 712 bp, Homo sapiens
atgagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaa

SEQ ID NO: 10885 - DNA, 966 bp, Homo sapiens
ctctaccaggtgagcactcatgaacagtctgagtccgcccatggacgcacagggcccagcactggaggaagacaaagatcccgccacgagcaggcacgagacagctccaggcactcagcgtcccaagagggtcaggacaccattcgtggacacccagggtcaagcagaggaggaaggcagggatcccactatgagcaatcggtagatagttctggacactcagggtctcatcacagccacaccacgtcccaggaaaggtctgatgtctcccgtgggcagtcaggatccagaagtgtcagcagacaaacacgtaatgagaaacaatcaggagacggctccaggcactcagggtcgcgtcaccatgaagcttcctctcgggccgacagctctagacactcgcaggtgggccagggacaatcatcagggcccaggacaagcaggaaccagggatccagtgttagccaggacagtgacagtcagggacactcagaagactctgagaggcggtctgggtctgcgtccagaaaccatcatggatctgctcaggagcagtcaagagatggctccagacaccccaggtcccatcacgaagacagagccggtcatgggcactctgcagagagctccagacaatcaggcactcatcatgcagagaattcctctggtggacaggctgcatcatcccatgaacaggcaagatcaagtgcaggagagagacacggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcaggg

SEQ ID NO: 10886 - DNA, 966 bp, Homo sapiens
ctctaccaggtgagcactcatgaacagtctgagtcctcccatggatggacggggcccagcactagaggaagacaaggatcccgccatgagcaggcacaagacagctccaggcactcagcatcccaagacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacggctccaggcactcagggtcgcgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcgtggatctgttcaggagcagtcaaggcacggctccagacaccccaggtcccatcacgaagacagagccggtcacgggcactctgcagaccgctccagacaatcaggcactcgtcacgcagagacttcctctggtggacaggctgcatcatcccatgaacaggcaagatcaagtccaggagagagacacggatcccgccaccagcagtcagcagacagctccagacactcaggcattccgcgtggacaagcttcatctgcagtcagagacagtagacactgggggtccagtggtagtcaggccagtgatagtgagggacattcagaagagtcagacacacagtcagtgtcaggccatggacaggctgggccccatcagcagagccaccaagagtccgcacgtgaccggtcagggggaaggtctggacgttcaggg

SEQ ID NO: 10887 - DNA, 12747 bp, Homo sapiens
cttttggtgaacaaggttcacatttattgccaaaagatgtctactctcctggaaaacatctttgccataattaatcttttcaagcaatattcaaaaaaagataaaaacactgacacattgagtaaaaaagagctgaaggaacttctggaaaaggaatttcggcaaatcctgaagaatccagatgacccagatatggttgatgtcttcatggatcacttggatatagaccacaacaagaaaattgacttcactgagtttcttctgatggtattcaagttggctcaagcatattatgagtctaccagaaaagagaatttaccgatatcaggacacaagcacagaaagcacagtcatcatgataaacatgaagataataaacaggaagaaaacaaagaaaacagaaaaagaccctcaagtctggaaagaagaaacaatagaaaagggaataagggaagatccaagagcccaagagaaacaggggggaaaaggcatgaatctagttctgaaaaaaaagaaagaaaaggatattcacctactcatagagaagaagaatatggaaaaaaccatcataactcaagtaaaaaagagaaaaacaagactgaaaatactagattaggagacaataggaagaggctaagtgaaagacttgaagagaaagaagacaatgaagaaggagtatatgattatgaaaatacaggaagaatgactcaaaaatggatacaatcaggccatattgccacatattacacaatccaggatgaagcctatgacaccactgatagtctattagaagaaaacaaaatatatgaaagatcaaggtcatctgatggcaaatcatcatctcaagtgaacaggtcaagacatgaaaatacaagccaggtaccattgcaggagtccaggacaagaaagcgtaggggatccagagttagccaggacagggacagtgagggacactcagaagactctgagaggcactctgggtcggcttccagaaaccatcatggatctgcgtgggagcagtcaagagatggctccagacaccccaggtcccatgatgaagacagagccagtcatgggcactctgcagacagctccagacaatcaggcactcgtcacgcagagacttcctctcgtggacagactgcatcatcccatgaacaggcaagatcaagtccaggagaaagacatggatccggccaccagcagtcagcagacagctccagacactcagccactgggcgcgggcaagcttcatctgcagtcagcgatcgtggacaccgggggtctagcggtagtcaggccagtgacagtgagggacattcagaaaactcagacacacaatcagtgtcaggccacggaaaggctgggctgagacagcagagccaccaagagtccacacgtggccggtcaggggaacggtctggacgttcagggtcttccctctaccaggtgagcactcatgaacagcctgactctgcccatggacggaccgggaccagcactggaggaagacaaggatcgcaccacgagcaggcacgagacagctccaggcattcagcgtcccaagagggtcaggacaccattcgtggacacccggggtcaagcagaggaggaaggcagggatcccaccacgagcaatcggtaaataggtctggacactcaggttcccatcacagccacaccacatcccagggaaggtctgatgcctcccatgggcagtcaggatccagaagtgcaagcagacaaacacgaaatgaggaacaatcaggagacggcaccaggcactcagggtcacgtcatcatgaagcttcctctcaggctgacagctctagacactcacaggtgggccagggacaatcatcggggcccaggacaagtaggaaccagggatccagtgttagccaggacagtgacagtcagggacactcagaagactctgagaggtggtctgggtctgcttccagaaaccatcatggatctgctcaggagcagtcaagagatggctccagacaccccaggtcccatcacgaagacagagctggtcatgggcactctgcagacagctccagaaaatcaggcactcgtcacacacagaattcctctagtggacaggctgcgtcatcccatgaacaggcaagatcaagtgcaggagaaagacatggatcccgccaccagctccagtcagcagacagctccagacactcaggcactgggcacggacaagcttcatctgcagtcagagacagtggacaccgagggtccagtggtagtcaggccactgacagtgagggacattcagaagactcagacacacagtcagtgtcaggccatggacaggctggtcaccatcagcagagccaccaagagtccgcacgtgaccggtcaggggaaaggtctcgacgttcagggtctttcctctaccaggtgagcactcataaacagtctgagtcctcccatggatggacagggcccagcactggagtaagacaaggatcccaccatgagcaggcacgagacaactccaggcactcagcatcccaagatggtcaggacaccattcgtggacacccggggtcaagcagaagaggaaggcaggggtcccaccacgagcaatcggtagataggtctggacactcagggtcccatcacagccacaccacatcccagggaaggtctgatgcctcccgtgggcagtcaggatccagaagtgcaagcagaacaacacgtaatgaggaacaatcaagagacggctccaggcactcagggtcacgtcaccatgaagcttcctctcatgccgacatctctagacactcacaggcaggccagggacaatcagaggggtccaggacaagcaggcgccagggatccagtgttagccaggacagtgacagtgagggacattcagaagactctgagaggtggtctgggtctgcttccagaaaccatcgtggatctgctcaggagcagtcaagacatggctccagacaccccaggtcccatcacgaagacagagccggtcacgggcactctgcagacagctccagacaatcaggaactcctcacgcagagacttcctctggtggacaggctgcgtcatcccatgaacaggcaagatcaagtccaggagaaagacacggatcccgccaccagcagtcagcagacagctccagacactcaggcattccgcgcagacaagcttcatctgcagtcagagacagtggacactgggggtccagtggtagtcaggccagtgatagtgagggacattcagaggagtcagacacacagtcagtgtcaggccatggacaggatgggccccatcagcagagccaccaagagtccgcacgtgactggtcagggggaaggtctggacgttcagggtctttcatctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtgcacacccggggtcaaggagaggaggaaggcagggatcccaccatgagcaatcggtagatagatctggacactcagggtcccatcacagccacaccacatcccagggaaggtctgatgcctcccatgggcagtcaggatccagaagtgcaagcagacaaactcgtaaggacaaacaatcaggagacggctccaggcactcagggtcacgtcaccatgaagctgcctcttgggctgacagctctagacactcacaggtgggacaggaacaatcatcggggtccaggacaagcaggcaccagggatccagtgttagccaggacagtgacagtgagagacactcagacgactccgagaggttgtctgggtctgcttccagaaaccatcatggatcttctcgggagcagtcaagagatggctccagacaccctgggttccatcaagaagacagagccagtcacgggcactctgcagacagctccagacaatcaggcactcatcacacagagtcttcctctcatggacaggctgtgtcatcccatgaacaggcaagatcaagtccaggagaaagacatggatcccgccaccagcagtcagcagacagctccagacactcaggcattgggcacagacaagcttcatctgcagtcagagacagtggacaccgagggtccagtggtagtcaggtcactaacagtgagggacattcagaagactcagacacacagtcagtgtcagcccacggacaagctgggccccatcagcagagccacaaagagtccgcacgtggccagtcaggggaaagctctggacgttcaaggtctttcctctaccaggtgagctctcatgaacagtctgagtccacacacggacagactgcacccagcactggaggaagacaaggatcccgccatgagcaggcacgaaacagctctaggcactcagcatcccaagacggtcaggacaccattcgtggacacccggggtcaagcagaggaggaaggcagggatcctaccacgagcaatcagtagataggtctggacactcagggtaccatcacagccacaccacaccccagggaaggtctgatgcctcccatgggcagtcaggacccagaagtgcaagcaggcaaacaagaaatgaggaacaatcaggagacggctccaggcactcagggtcacgtcaccatgaaccttccactcgggccggcagctctagacactcacaggtgggccagggagaatcagcggggtccaagacaagcaggcgccagggatccagtgttagtcaggacagggacagtgagggacactcagaagactctgagaggcggtctgagtcggcttccagaaaccattatggatctgctcgggagcagtcaagacatggctccaggaaccccaggtcccatcaagaagatagagccagtcatgggcactctgcagagagctccagacaatcaggcactcgtcatgcagagacttcctctggtggacaggctgcatcatcccaggaacaggcaaggtcaagtccaggagaaagacatggatcccgccaccagcagtcagcagacagctccacagactcaggcactgggcgcagacaagattcatctgtagtcggagacagtggaaaccgagggtccagtggtagccaggccagtgacagcgagggacactcagaagagtcagacacacagtcagtgtcagcccacggacaggctgggccccatcagcagagccaccaagagtccacacgtggccagtcaggggaaaggtctggacgttcagggtctttcctctaccaggtgagcactcatgaacagtctgagtccgcccatggacgcacagggcccagcactggaggaagacaaagatcccgccacgagcaggcacgagacagctccaggcactcagcgtcccaagagggtcaggacaccattcgtggacacccagggtcaagcagaggaggaaggcagggatcccactatgagcaatcggtagatagttctggacactcagggtctcatcacagccacaccacgtcccaggaaaggtctgatgtctcccgtgggcagtcaggatccagaagtgtcagcagacaaacacgtaatgagaaacaatcaggagacggctccaggcactcagggtcgcgtcaccatgaagcttcctctcgggccgacagctctagacactcgcaggtgggccagggacaatcatcagggcccaggacaagcaggaaccagggatccagtgttagccaggacagtgacagtcagggacactcagaagactctgagaggtggtctgggtctgcttccagaaaccatcttggatctgcttgggagcagtcaagagatggctccagacaccctgggtcccatcacgaagacagagccggtcacgggcactctgcagacagctccagacaatcaggcactcgtcacacagagtcttcctctcgtggacaggctgcgtcatcccatgaacaggcaagatcaagtgcaggagaaagacatggatcccaccaccagctccagtcagcagacagctccagacactcaggcattgggcatggacaagcttcatctgcagtcagagacagtggacaccgagggtacagtggtagtcaggccagtgacagtgagggacattcagaagactcagacacacagtcagtgtcagcacagggaaaagctgggccccatcagcagagccacaaagagtccgcacgtggccagtcaggggaaagctctggacgttcagggtctttcctctaccaggtgagcactcatgaacagtctgagtccacccatggacagtctgcgcccagcactggaggaagacaaggatcccattatgatcaggcacaagacagctccaggcactcagcatcccaagagggtcaggacaccattcgtggacacccggggccaagcagaggaggaagacaggggtcccaccaagagcaatcggtagataggtctggacactcagggtctcatcacagccacaccacatcccagggaaggtctgatgcctcccgtgggcagtcaggatccagaagtgcaagcagaaaaacatatgacaaggaacaatcaggagatggctctaggcactcagggtcgcatcatcatgaagcttcctcttgggccgacagctctagacactcactggtgggccagggacaatcatcagggcccaggacaagcaggccccggggatccagtgttagccaggacagtgacagtgagggacactcagaagattctgagaggcggtctgggtctgcgtccagaaaccatcatggatctgctcaggagcagtcaagagatggctccagacaccccaggtcccatcacgaagacagagccggtcatgggcactctgcagagagctccagacaatcaggcactcatcatgcagagaattcctctggtggacaggctgcatcatcccatgaacaggcaagatcaagtgcaggagagagacacggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcagggtctttcctctaccaggtgagcactcatgaacagtctgagtccgcccatggacggaccgggaccagcactggaggaagacaaggatcccaccacaagcaggcacgagacagctccaggcactcaacgtcccaagagggtcaggacaccattcatggacacccggggtcaagcagtggaggaaggcagggatcccactacgagcaattggtagatagatctggacactcagggtctcatcacagccacaccacatcccagggaaggtctgatgcctcccatgggcactcaggatccagaagtgcaagcagacaaactcgtaacgatgaacaatcaggagacggctccaggcactcagggtcgcgtcaccatgaagcttcctctcgggccgacagctctggacactcgcaggtgggccagggacaatcagaggggcccaggacaagcaggaactggggatccagttttagccaggacagtgacagtcagggacactcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggagaaagacatggatcccaccaccagcagtcagcagacagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcaggggaaacgtctggacattcaggatctttcctctaccaggtgagcactcatgaacagtctgagtcctcccatggatggacggggcccagcactagaggaagacaaggatcccgccatgagcaggcacaagacagctccaggcactcagcatcccaagacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacggctccaggcactcagggtcgcgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggagaaagacatggatcccaccaccagcagtcagcagacagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcaggggaaacgtctggacattcaggatctttcctctaccaggtgagcactcatgaacagtctgagtcctcccatggatggacggggcccagcactagaggaagacaaggatcccgccatgagcaggcacaagacagctccaggcactcagcatcccaatacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacagctccaggcactcagtgtcacgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcgtggatctgttcaggagcagtcaaggcacggctccagacaccccaggtcccatcacgaagacagagccggtcacgggcactctgcagaccgctccagacaatcaggcactcgtcacgcagagacttcctctggtggacaggctgcatcatcccatgaacaggcaagatcaagtccaggagagagacacggatcccgccaccagcagtcagcagacagctccagacactcaggcattccgcgtggacaagcttcatctgcagtcagagacagtagacactgggggtccagtggtagtcaggccagtgatagtgagggacattcagaagagtcagacacacagtcagtgtcaggccatggacaggctgggccccatcagcagagccaccaagagtccgcacgtgaccggtcagggggaaggtctggacgttcagggtctttcctctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtggacacccggggtcaagcagaagaggaaggcagggatcccactacgagcaatcggtagataggtctggacactcagggtcccatcacagccacaccacatcccagggaaggtctgatgcctcccgtgggcagtcaggatccagaagtgccagcagacaaactcgtaatgacgaacaatcaggagatggctccaggcactcatggtcgcatcaccatgaagcttccactcaggcggacagctctagacactcacagtccggccagggacaatcagcggggcccaggacaagcaggaaccagggatccagtgttagccaggacagtgacagtcagggacactcagaagactctgagaggtggtctgggtctgcttccagaaaccatcgtggatctgctcaggagcagtcaagagatggctccagacaccccacgtcccatcacgaagacagagccggtcacgggcactctgcagagagctccagacaatcaggcactcatcatgcagagaattcctctggtggacaggctgcatcatcccatgaacaggcaagatcaagtgcaggagagagacatggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcagggtctttcctctaccaggtgagcactcatgaacagtctgagtctgcccatggacgggctgggcccagtactggaggaagacaaggatcccgccacgagcaggcacgagacagctccaggcactcagcgtcccaagagggtcaggacaccattcgtggacacccggggtcaaggagaggaggaagacagggatcctaccacgagcaatcggtagataggtctggacactcagggtcccatcacagccacaccacatcccagggaaggtctgatgcctcccatgggcagtcaggatccagaagtgcaagcagagaaacacgtaatgaggaacagtcaggagacggctccaggcactcagggtcgcgtcaccatgaagcttccactcaggctgacagctctagacactcacagtccggccagggtgaatcagcggggtccaggagaagcaggcgccagggatccagtgttagccaggacagtgacagtgaggcatacccagaggactctgagaggcgatctgagtctgcttccagaaaccatcatggatcttctcgggagcagtcaagagatggctccagacaccccggatcctctcaccgcgatacagccagtcatgtacagtcttcacctgtacagtcagactctagtaccgctaaggaacatggtcactttagtagtctttcacaagattctgcgtatcactcaggaatacagtcacgtggcagtcctcacagttctagttcttatcattatcaatctgagggcactgaaaggcaaaaaggtcaatcaggtttagtttggagacatggcagctatggtagtgcagattatgattatggtgaatccgggtttagacactctcagcacggaagtgttagttacaattccaatcctgttgttttcaaggaaagatctgatatctgtaaagcaagtgcgtttggtaaagatcatccaaggtattatgcaacgtatattaataaggacccaggtttatgtggccattctagtgatatatcgaaacaactgggatttagtcagtcacagagatactattactatgagtaagaaattaatggcaaaggaattaatccaagaatagaagaatgaagcaagttcactttcaatcaagaaacttcataatactttcagggaagttatcttttcctgtcaatctgtttaaaatatgctatagtatttcattagtttggtggtagcttatttttattgtgtaatgatctttaaacgctatatttcagaaatattaaatggaagaaatcaatatcatggagagctaactttagaaaactagctggagtattttaggagattctgggtcaagtaatgttttatgtttttgaaagtttaagttttagacactccccaaatttctaaattaatctttttcagaaatatcgaaggagccaaaaatataaaacagttctgtataccaaagtggctatatcaacatcagggctagcacatctttctctattatccttctattggaattctagtattctgtattcaaaaaatcatcttggacataattaatattatagtaagctgcatctaaattaaaaataaactatt

SEQ ID NO: 10888 - DNA, 966 bp, Homo sapiens
ctctaccaggtgagcactcatgaacagcctgactctgcccatggacggaccgggaccagcactggaggaagacaaggatcgcaccacgagcaggcacgagacagctccaggcattcagcgtcccaagagggtcaggacaccattcgtggacacccggggtcaagcagaggaggaaggcagggatcccaccacgagcaatcggtaaataggtctggacactcaggttcccatcacagccacaccacatcccagggaaggtctgatgcctcccatgggcagtcaggatccagaagtgcaagcagacaaacacgaaatgaggaacaatcaggagacggcaccaggcactcagggtcacgtcatcatgaagcttcctctcaggctgacagctctagacactcacaggcaggccagggacaatcagaggggtccaggacaagcaggcgccagggatccagtgttagccaggacagtgacagtgagggacattcagaagactctgagaggtggtctgggtctgcttccagaaaccatcgtggatctgctcaggagcagtcaagacatggctccagacaccccaggtcccatcacgaagacagagccggtcacgggcactctgcagacagctccagacaatcaggaactcctcacgcagagacttcctctggtggacaggctgcgtcatcccatgaacaggcaagatcaagtccaggagaaagacacggatcccgccaccagcagtcagcagacagctccagacactcaggcattccgcgcagacaagcttcatctgcagtcagagacagtggacactgggggtccagtggtagtcaggccagtgatagtgagggacattcagaggagtcagacacacagtcagtgtcaggccatggacaggatgggccccatcagcagagccaccaagagtccgcacgtgactggtcagggggaaggtctggacgttcaggg

SEQ ID NO: 10889 - DNA, 4219 bp, Homo sapiens
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 10890 - DNA, 3970 bp, Homo sapiens
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagacttttaaggcattccaaatcccagtcttcatgttgaactgggttaagcatttattaaaaaatcgttttcttcta

SEQ ID NO: 10891 - DNA, 3274 bp, Homo sapiens
ataggccgggcgcgctcagcgccccgctcgcattgttcgggcgactctcggagcgcgcacagtcggctcgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 10892 - DNA, 1712 bp, Homo sapiens
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagatggagtctagctctgctgccgaggctggagtgcaatggcatgatcttggctcactgcaatctctgcctcctgggttcaagtgattctcctgcctcagcattccaagtagctgggattacaggcacccgccatcatgcccagctagtttttgtatttttgtagagacagagtttcaccatgttggccaggctagtcttgaacccctgacctcaggtgatccacccacctcggcctcccaaagtgctgggataacaggcatgagccaacgcgcttgacttgcacatatatttttaatgtgtgagtgggtgcatgtcataattccagatggaaatttgtcaccacaaaacataatttttatttagctgatctttccaggtttctatttataatggaatgaaaagatgaagttgggcttatgaatcaagacaaacacaggccctggtcattgtgtaattccatatagtataatttgtttgcaatctttcattccatacacctacaatacagctctaaaaataatgctacctacaatataaagatatactttttttccaaataaccttcaaaaatgtcaaaatatgcaacaaaaatattgtatcatatctaaaccctcaaataagctacatttaaaccaa

SEQ ID NO: 10893 - DNA, 2837 bp, Homo sapiens
ggagcgcgcacagtcggctcgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactga

SEQ ID NO: 10894 - DNA, 2854 bp, Homo sapiens
ggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagac

SEQ ID NO: 10895 - DNA, 2321 bp, Homo sapiens
ttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagac

SEQ ID NO: 10896 - DNA, 2898 bp, Homo sapiens
acagtcggctcgcagcgcggcactacagcggccccggcccggcccccgcccggccccggcgcaggcagttcagggaagcccaccataatgagaagagcggggccaacacccatgtcactgtggagaagtacagaatatgcaatggaagagttgtttatctgatataagcggtaattggaaactgaaaaattcctgctctggaaaaaagatattctgctcttctgaatctaacagaggaagagacaaacagaaaccatcaattattgtttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccct

SEQ ID NO: 10897 - DNA, 8382 bp, Homo sapiens
gcgcgtcgcgcgcagcggacgccgacagaatccccgaggcgcctggcgcgggcgcgggcgcgaaggcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagcca

SEQ ID NO: 10898 - DNA, 7319 bp, Homo sapiens
agagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattc

SEQ ID NO: 10899 - DNA, 3223 bp, Homo sapiens
aaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagagggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcaga

SEQ ID NO: 10900 - DNA, 8486 bp, Homo sapiens
attcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccatt

SEQ ID NO: 10901 - DNA, 9463 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 10902 - DNA, 9344 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaagttg

SEQ ID NO: 10903 - DNA, 9537 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccaggggtcagagtcatgaactgctctgcccagatcctgtggggctggagggtgcagtttcatactggctctagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaagttg

SEQ ID NO: 10904 - DNA, 9391 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 10905 - DNA, 8762 bp, Homo sapiens
atgcaagaacatagcacccggaggagaagtctcagtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaagttg

SEQ ID NO: 10906 - DNA, 9430 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 10907 - DNA, 404 bp, Homo sapiens
cttggcggtggaaggccccagcaaagtggacatccagacggaggacctggaagatggcacctgcaaagtctcctacttccctaccgtgcctggggtttatatcgtctccaccaaattcgctgacgagcacgtgcctgaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccag

SEQ ID NO: 10908 - DNA, 8079 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgagctgacgacacggattcccagtcatggcgcagccccttgaaagccctttcagagttctttaaaggtgacccgaagggtgactttaataagacaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctc

SEQ ID NO: 10909 - DNA, 9188 bp, Homo sapiens
ttcttaaaccccccgccccggcccagcccgcccttcccgagcaccgctccggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggattgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 10910 - DNA, 9042 bp, Homo sapiens
cggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggattgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcaga

SEQ ID NO: 10911 - DNA, 461 bp, Homo sapiens
gacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttag

SEQ ID NO: 10912 - DNA, 533 bp, Homo sapiens
gacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagat

SEQ ID NO: 10913 - DNA, 355 bp, Homo sapiens
tcgccaatatgcagctctttgtccgcgcccaggagctacacaccttcgaggtgaccggccaggaaacggtcgcccagatcaaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtc

SEQ ID NO: 10914 - DNA, 507 bp, Homo sapiens
gcggtagctgggaccgccgttcaggtaagaatggggccttggctggatccgaagggcttgtagcaggttggctgcggggtcagaaggcgcggggggaaccgaagaacggggcctgctccgtggccctgctccagtccctatccgaactccttgggaggcctggccttccccactcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcg

SEQ ID NO: 10915 - DNA, 538 bp, Homo sapiens
gcggtagctgggaccgccgttcaggtaagaatggggccttggctggatccgaagggcttgtagcaggttggctgcgggtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtc

SEQ ID NO: 10916 - DNA, 1125 bp, Homo sapiens
tcgcgatcgtttctggaccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagatcctagtctggttatcagcttccacactaaaattaggtcagaccagggcccccaaagtgctctataaaattagaagctggaagatcctgaaatgaaacttaagatttcaaggtcaaatatctgcaactttgttctcattacctattgggcgcagcttctctttaaaggcttgaattgagaaaagaggggttctgctgggtggcaccttcttgctcttacctgctggtgccttcctttcccactacaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagaagacaggtcgggctaagcggcggatgcagtacaaccggcgctttgtcaacgttgtgcccacctttggcaagaagaagggccc

SEQ ID NO: 10917 - DNA, 847 bp, Homo sapiens
gagcctcacacccacgcgatgccctcagctcctcgctcagcgctctcaccaacagccgtagcccgcagccccgctggacaccggttctccatccccgcagcgtagcccggaacatggtagctgccatctttacctgctacgccagccttctgtgcgcgcaactgtctggtcccgccccgtcctgcgcgagctgcctgcccaggcaggttcgccggtgcgagcgtaaaggggcggagctaggactgccttgggcggtacaaatagcagggaaccgcgcggtcgctcagcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcatc

SEQ ID NO: 10918 - DNA, 697 bp, Homo sapiens
cttgtagcaggttggctgcggggtcagaaggcgcggggggaaccgaagaacggggcctgctccgtggccctgctccagtccctatccgaactccttgggaggcctggccttccccacgtgagccgccgcgaccaccatcccgtcgcgatcgtttctggaccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtca

SEQ ID NO: 10919 - DNA, 1878 bp, Homo sapiens
gccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaa

SEQ ID NO: 10920 - DNA, 2198 bp, Homo sapiens
atgcgcagacggacctgcgctggaggcttcatctttgccgccgctgccgtcgccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgacttta

SEQ ID NO: 10921 - DNA, 2180 bp, Homo sapiens
atgcgcagacggacctgcgctggaggcttcatctttgccgccgctgccgtcgccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgacttta

SEQ ID NO: 10922 - DNA, 734 bp, Homo sapiens
agtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 10923 - DNA, 2541 bp, Homo sapiens
cccgagcctctctccctggccaggccccaggtctcgcagccagggatggagatggggggagggggaacctagagttctttgtagtgcctccctcagactctaacacactcagcctggccccctcctcctattgcaaccccctcccccgctcctcccggccaggccagctcagtcttcccagcccccattccacgtggaccagccagggcgggggtagggaaagaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaacc

SEQ ID NO: 10924 - DNA, 2658 bp, Homo sapiens
agaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 10925 - DNA, 2581 bp, Homo sapiens
ctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaacc

SEQ ID NO: 10926 - DNA, 398 bp, Homo sapiens
gtagtgcctccctcagactctaacacactcagcctggccccctcctcctattgcaaccccctcccccgctcctcccggccaggccagctcagtcttcccagcccccattccacgtggaccagccagggcggggggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctac

SEQ ID NO: 10927 - DNA, 1965 bp, Homo sapiens
tgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactgactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 10928 - DNA, 1926 bp, Homo sapiens
agagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactgactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaacc

SEQ ID NO: 10929 - DNA, 952 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaa

SEQ ID NO: 10930 - DNA, 1010 bp, Homo sapiens
ccgcgcaggtcccgactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaa

SEQ ID NO: 10931 - DNA, 657 bp, Homo sapiens
ggcgtgtggccgcgggtttcgcacggtccaataagggagggcggcgtggcccggcctggtagcgacgaggacgcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggtggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaa

SEQ ID NO: 10932 - DNA, 1002 bp, Homo sapiens
gtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcgtgagtggggccgcccagtcggggcaactgcagtgcagccagatagggtctggactttgcgtaaagggacaggcgggaactgaagagcggaggtggggactgggagggagggaaggtatgggggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggtggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcccaa

SEQ ID NO: 10933 - DNA, 613 bp, Homo sapiens
ctggggggagccggggtgcaagagggcaggctggatcaggccgggcagaagcggaccgggctccgagtgtcaacgagagctagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggtggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaa

SEQ ID NO: 10934 - DNA, 639 bp, Homo sapiens
tggccccgggcgtcctcgcgggggtggtctccgtggtggccgggcttggggacgccgtaggccgagaactccaccgggagaggtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgc

SEQ ID NO: 10935 - DNA, 1684 bp, Homo sapiens
gtcagcctacatttttttaagtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaatt

SEQ ID NO: 10936 - DNA, 1346 bp, Homo sapiens
gccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaatt

SEQ ID NO: 10937 - DNA, 4093 bp, Homo sapiens
aacaaactcctacctctgtttgcaactaagagttacatcccccatgccaagaccttccgaggcgtcccaaagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggagggcgccgggcgctgccccggggattcgggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtga

SEQ ID NO: 10938 - DNA, 3782 bp, Homo sapiens
gattcgggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcc

SEQ ID NO: 10939 - DNA, 7220 bp, Homo sapiens
ctactgatgaaggtgccaagaacaatgaagaaagccccacagccactgttgctgagcagggagaggatattacctccaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaaggccaaagaatcctgggagatggataccaaagaaaaattggagcaggctgccattgtcaaagagaagggaaccgtatacttcaaggtgtgtgagtccctatgcaatcctttccatctcaaagaatttattcaagtgttggtgaattgtgctgatattccctactctgaattttgtcaacactgcttggtaagaataagctgcaatttttataaatctgtcattttcaatatgaaaaatggtgagaaaacaatcatgtggaaaaaaaaaaaagtacagattcctcttttacacattctgctctagattgtaaccttccatacaggcagaccaggtctggcatccccacccaccacagtatcactcactcctaaagcatcttgcttggtacatagttggcactcaacaagtgtttttggaatgaaaaaagaatgaatagaataattgttagcaaagaatggaattcataagggtaagtttcacatcatttttctttcttcctttttttttttttgtatgagagacagggtctccctttctttcccaggctggtctcaaacttctagcctcaagcaatcctcccacctcagcttcccaaagtgctgagattacaggcgtgagccactgcaccgggcccatcttcctttagactgtcttgatgaagtcactagagcatatgataaaaggagagaggacatgcacaaatttcaaaacaaactgacaggagagtattgattgcttctaatggccaagatgattcctgcacacttgcttttatgaggaatctccggatattcctgaatgatattcatcataaattgcttctcagaaacccttcttggagcaactaggagtgtgatattttctcacttagatcttaaacctctagatgtaagaaaaaaagaaaccgcccttcattctgttttaatcagtgttctacccattgcttccccaccccaaatatatgccttctccatgtcaagcagaaagggcttagtgatgagaattagagggagaatgggagttctgtcaaggtttctttcgttttctgccactgcaatacagaaattagatgtttttcagcagtataaagcagtgaggcataagtgtactttaacaagtctttatggggcatctgctataagacatgctattattaagttacaaccttgtcaggagggaggagtggcaatgttaatccaaatgaaacaactagagaattatgtaagaatatataatcaacccaaaattaacacagccagagggcaccatgtgttttcagaatttgagctgagacaatattgggtcatgaaatcagttttgtggaagtgtattgcaatatgttataaggatcagttttgttgcataaaactttgcttgtgtatgagtaagtactggattgcatatttcttactgtgggtggtattcaaacaaattttaaatcatgggtttagataagtataaatatataaatatgttatttatcattatttactatgtatactaaactcttatggatcaccagaaagcatgggggtatgatagaataagctcagaattgggaaaaatgggctttattgctcttcaaatgatttagtcatttaaggtccaaagaggttatattttcaagtgaaaaataggggagttagatgttccccaagtttctttccagcctgaatttctgtgagtttctaaactctcaagaacaagtgttatttttttggttttgttttgtttttaattctaattgaggtatattggatacttctaaactattcaagtaagattccaagtgggttatttgtatatccaaatacataatacactagagggaaaaatgtttctacaaaatttcttaagatcgtgagtccttaacagtattttctatatttccgaagtccataaaaatccttaactatattttatatatttcctcaatacttccaaatagaatattaacagtttgggaagatttgaggcttttggcctttgactagaattatatcgattcagtgtagtaaaacagctcagctattcagaggctctaatcggtgctatgatacagaattttggagaacattattggtaatgaaataatgttatgaagccatctgtcatatagctgtgttctgaatatatacagagagatggccagaattagtgatcagtagcagaaagcaatgagtgtctgtacagttacttaactttgttgcttatcagcatcacaactgcaagagtgatactattatgaacctacttaaaattaccaatctttggataaaatctggatcagcagtcacacacatggaaaaaattatttttaacatggaatttgataggcaaaatttttcaaaacattagtccattggggaaaaattaatgaaaggttcaaaaccactgacctgagacttttctcccagaatgtctctgaacattttgtaccactaaaaacttccctggaggcacctttataattataggtaaaagatcccagcagtagtcctagcgttagctgtaaaacttcaaaatggttagtagatagtttcctgtacatattcccttcccaactcagggcaggtttcaatctgccatactgccctcccgggccttgtctttccagggtgtctgacttggcatgttatgcatttgcacagagtccagatgtgtaggtgagagcagagatgggctgaactaaagatctgtatttcatgccatctgcatattggaattctgtttccattgatctgttggtttggtttatacctaaatgggtaaagcctctctcctgagtaggattgaattgtactcagcttttaagtgggaatgattttgccattgaagatgtaaagtcctcatttcaacctctgaatactaaagagaagaaaaatagagaactctatttggctctgaaaataattattaagtacaggtaacagcataatattaagccaggcattgtgcaagcgagttaaacagacacgatttttgccctcatagctgacagtgttctgcaggacaggagcattaactcacacctggtcagtgtttttcttttttctgacttggcagcagagtggcaagaaggctaagaacactgaagtgatgtgggattcttgcgcccccttgtgcttctcctgggaagaaagcatttctaaaacaaactagttgaggagaattgttcaacctctaaactcttcagataaatcgggctttgctatattttcaccacccttgctgttccaagataccagtaatgtgatttagaaacaagccgtttatgactctaggatttgatgttttaaaaaaaattcctaagaagagtccaccctgtctttcatctctttcctttagtgcagaatttttcaacctcagtactatcaacatttggagtgggataattcttgattgtgtggggctgtcttgtgcattgtagaatatttagcagcattcctggcctctgcccattagatgccagtagcatcctacccagttatgacaactaaaaatgcctccagacctgccaggtgttccctggggggcaaaatcaccccccagttgagaactgctttagtacctcagaagcagggagtacaagacagacttttcgctaattggaagttgaagtctaaataaagttacatgatatatatgcaagagctttcaaaaaattaaaatgccctatgtgaaggaactattaagaagtctaatacctgttttttgtgttttgttttgttttaccatggccttctaccattctgattattcagaacttattgaaatgttaagatctaggtttttgtcctccctggctcttcttttctttccctatacaatatattaggagataatcagaaaagttaagttaatcaatgcattagagagggaggaggagagaggatgaagaaatgaggcatgacaggggaaatgcctgtccttcctatctcatctcagtgaaacaacacttttcatttccacccacacattttttgctcccaatgatagcaaaaggttttgttgttggtattgtttttagagagagagggtcttactctgtcacccaggctggagtgcagtggcacaagcatagctaactgcagcttcgaactcctggacttaagagatcctcctgcctcagcttcccaaagtgctgggactataggcgtgagccaccacaccactttagaaaaagtcttgattccatatttacattcctttgatttcaatatttactcaacaaacctttattaaagacctcttggtgctaaaccctgaatattccaaaagggagaggacaatgctgcctgtcctcaaagaccagcaagagaaaaggcagtgacagaaagaaaatgccgacctgaaactggtgaggactttattcttttttttttgtagcatccaaaaaaggagtggtaggcctaagactatgacaaaatttaagtattgtcttagcttgggctgccacagtaaaataccatacactgggtggcttcaacaacaggaatttacttctggagactgtaagtcccagatcaaggtgttagcaggatcagtgtctggggagggcctctcctctggttccttgtagctcccttcttgctgtgttctcacatggcctttccacatgcatgtgagtggagagagggcagagggcagcaagcacccgagtttcttcttataaaggctctaatcccatcatgaggccccaccctcatgaccacatctaacctaattccctccccaaatgctccatctgcaaatatcacattcggggtgagggcttcaacataggaatttaggatgggggacacaattcagtccatagcaaatctaatttcctcaagaatttcagcatttaaaataaaatgccctggtttcgtgttcttatgaatgacctgtatcacacacttctgaggcagagagggtgacagactttgattttagtgccagtcttccctctcctaagtgagtgacttgggaagaaggatgttcgagggatgtagcctggccctcattcacacccaggccctccagctggaacaggtctgccccatcttcatcaccagaaaatccacaccagggcttcctttctacaggcagagctcgtttcttacatcacccacttgaagtcctgtatcacaggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaatttaatgtcctaataggtctggctgctcctctgccatctggcaggatgtatcatctgtggttttgagcttatcacctcctcaaaggagaatccccacttgtactcctgtttctatttgcgtatttaccagcgattccccagtgctttcatttaccttaaaatcacagtggacacattgtctcagccctggaggggttttgttttgttttgttttgttttgttttgtttttgaggagtctcgctctgtcacccaggctggagtgcagtggcatgatcttggctcactgcaacctctgcctcttaggttcaagcagttctcctgcctcagcctcctaagtagccgggattacaggcatatgccaccatgcctggctcatttttgtatttttagtagagacggccaggctggtctcgaactcctgacctcaggtgatccacctgtctcggcctccaaagtgctgggattacaggtatgagccactgtgctcagcccccagcgtttctcatatgagcatgtatatatatatatattatatatatattatatatgtttatatttatatatattatatataactgacagacctttctgatgtatattgttttatagttgttatttatgttgtatgctactatccaactattcatattcccattgcctatagatcaggggtcagcaaactacagtttgctggccaaatctggtccctgcctgtttttgtaagtacagtttaactgaaacacagctgcacccattgatttacatactgtctagagcagcttttgcactacaaatgataagaatttagtagttgcaacagagactggttcaaataggattggctgtgtttggaactagcacttgccagaatgtaatatttgctgtgaagtgctgaaaagaaaagtaacttccttttcatttttttagtggcatagtctaaaactgctcacaatccttttgaaagactaaagaataggccaggtgtggtggctcatgcctgtaatcccagcactttgggaggccaaggcaggcggatcacaaggtcaggagttcaagaccagcctggccaacatagtgaaacgctgtctctactaaaaatacaaaaaaaaatagctgggcttggtggcggccacctgtagtccccagctactcgggaggctgaggcaggagaatcgctggaacccgggaggcggaggttgcagtgagctgagatggcgccattgcactccagccctggagacagtgcgagactgtgtctc

SEQ ID NO: 10940 - DNA, 3940 bp, Homo sapiens
agaacaaactcctacctctgtttgcaactaagagttacatcccccatgccaagaccttccgaggcgtcccaaagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcc

SEQ ID NO: 10941 - DNA, 3827 bp, Homo sapiens
agtctcgggcggcggtgtccggcgcgcgggcggcctgctgggcgggctgaagggttagcggagcacgggcaaggcggagagtgacggagtcggcgagcccccgcggcgacaggtaccggcgccatggccacggagatggggcggccggccgcggcgccccgggagccgaacgccctccttccaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcc

SEQ ID NO: 10942 - DNA, 1414 bp, Homo sapiens
agtctcgggcggcggtgtccggcgcgcgggcggcctgctgggcgggctgaagggttagcggagcacgggcaaggcggagagtgacggagtcggcgagcccccgcggcgacagtccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtagggg

SEQ ID NO: 10943 - DNA, 7384 bp, Homo sapiens
gattcgggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaaggccaaagaatcctgggagatggataccaaagaaaaattggagcaggctgccattgtcaaagagaagggaaccgtatacttcaaggtgtgtgagtccctatgcaatcctttccatctcaaagaatttattcaagtgttggtgaattgtgctgatattccctactctgaattttgtcaacactgcttggtaagaataagctgcaatttttataaatctgtcattttcaatatgaaaaatggtgagaaaacaatcatgtggaaaaaaaaaaaagtacagattcctcttttacacattctgctctagattgtaaccttccatacaggcagaccaggtctggcatccccacccaccacagtatcactcactcctaaagcatcttgcttggtacatagttggcactcaacaagtgtttttggaatgaaaaaagaatgaatagaataattgttagcaaagaatggaattcataagggtaagtttcacatcatttttctttcttcctttttttttttttgtatgagagacagggtctccctttctttcccaggctggtctcaaacttctagcctcaagcaatcctcccacctcagcttcccaaagtgctgagattacaggcgtgagccactgcaccgggcccatcttcctttagactgtcttgatgaagtcactagagcatatgataaaaggagagaggacatgcacaaatttcaaaacaaactgacaggagagtattgattgcttctaatggccaagatgattcctgcacacttgcttttatgaggaatctccggatattcctgaatgatattcatcataaattgcttctcagaaacccttcttggagcaactaggagtgtgatattttctcacttagatcttaaacctctagatgtaagaaaaaaagaaaccgcccttcattctgttttaatcagtgttctacccattgcttccccaccccaaatatatgccttctccatgtcaagcagaaagggcttagtgatgagaattagagggagaatgggagttctgtcaaggtttctttcgttttctgccactgcaatacagaaattagatgtttttcagcagtataaagcagtgaggcataagtgtactttaacaagtctttatggggcatctgctataagacatgctattattaagttacaaccttgtcaggagggaggagtggcaatgttaatccaaatgaaacaactagagaattatgtaagaatatataatcaacccaaaattaacacagccagagggcaccatgtgttttcagaatttgagctgagacaatattgggtcatgaaatcagttttgtggaagtgtattgcaatatgttataaggatcagttttgttgcataaaactttgcttgtgtatgagtaagtactggattgcatatttcttactgtgggtggtattcaaacaaattttaaatcatgggtttagataagtataaatatataaatatgttatttatcattatttactatgtatactaaactcttatggatcaccagaaagcatgggggtatgatagaataagctcagaattgggaaaaatgggctttattgctcttcaaatgatttagtcatttaaggtccaaagaggttatattttcaagtgaaaaataggggagttagatgttccccaagtttctttccagcctgaatttctgtgagtttctaaactctcaagaacaagtgttatttttttggttttgttttgtttttaattctaattgaggtatattggatacttctaaactattcaagtaagattccaagtgggttatttgtatatccaaatacataatacactagagggaaaaatgtttctacaaaatttcttaagatcgtgagtccttaacagtattttctatatttccgaagtccataaaaatccttaactatattttatatatttcctcaatacttccaaatagaatattaacagtttgggaagatttgaggcttttggcctttgactagaattatatcgattcagtgtagtaaaacagctcagctattcagaggctctaatcggtgctatgatacagaattttggagaacattattggtaatgaaataatgttatgaagccatctgtcatatagctgtgttctgaatatatacagagagatggccagaattagtgatcagtagcagaaagcaatgagtgtctgtacagttacttaactttgttgcttatcagcatcacaactgcaagagtgatactattatgaacctacttaaaattaccaatctttggataaaatctggatcagcagtcacacacatggaaaaaattatttttaacatggaatttgataggcaaaatttttcaaaacattagtccattggggaaaaattaatgaaaggttcaaaaccactgacctgagacttttctcccagaatgtctctgaacattttgtaccactaaaaacttccctggaggcacctttataattataggtaaaagatcccagcagtagtcctagcgttagctgtaaaacttcaaaatggttagtagatagtttcctgtacatattcccttcccaactcagggcaggtttcaatctgccatactgccctcccgggccttgtctttccagggtgtctgacttggcatgttatgcatttgcacagagtccagatgtgtaggtgagagcagagatgggctgaactaaagatctgtatttcatgccatctgcatattggaattctgtttccattgatctgttggtttggtttatacctaaatgggtaaagcctctctcctgagtaggattgaattgtactcagcttttaagtgggaatgattttgccattgaagatgtaaagtcctcatttcaacctctgaatactaaagagaagaaaaatagagaactctatttggctctgaaaataattattaagtacaggtaacagcataatattaagccaggcattgtgcaagcgagttaaacagacacgatttttgccctcatagctgacagtgttctgcaggacaggagcattaactcacacctggtcagtgtttttcttttttctgacttggcagcagagtggcaagaaggctaagaacactgaagtgatgtgggattcttgcgcccccttgtgcttctcctgggaagaaagcatttctaaaacaaactagttgaggagaattgttcaacctctaaactcttcagataaatcgggctttgctatattttcaccacccttgctgttccaagataccagtaatgtgatttagaaacaagccgtttatgactctaggatttgatgttttaaaaaaaattcctaagaagagtccaccctgtctttcatctctttcctttagtgcagaatttttcaacctcagtactatcaacatttggagtgggataattcttgattgtgtggggctgtcttgtgcattgtagaatatttagcagcattcctggcctctgcccattagatgccagtagcatcctacccagttatgacaactaaaaatgcctccagacctgccaggtgttccctggggggcaaaatcaccccccagttgagaactgctttagtacctcagaagcagggagtacaagacagacttttcgctaattggaagttgaagtctaaataaagttacatgatatatatgcaagagctttcaaaaaattaaaatgccctatgtgaaggaactattaagaagtctaatacctgttttttgtgttttgttttgttttaccatggccttctaccattctgattattcagaacttattgaaatgttaagatctaggtttttgtcctccctggctcttcttttctttccctatacaatatattaggagataatcagaaaagttaagttaatcaatgcattagagagggaggaggagagaggatgaagaaatgaggcatgacaggggaaatgcctgtccttcctatctcatctcagtgaaacaacacttttcatttccacccacacattttttgctcccaatgatagcaaaaggttttgttgttggtattgtttttagagagagagggtcttactctgtcacccaggctggagtgcagtggcacaagcatagctaactgcagcttcgaactcctggacttaagagatcctcctgcctcagcttcccaaagtgctgggactataggcgtgagccaccacaccactttagaaaaagtcttgattccatatttacattcctttgatttcaatatttactcaacaaacctttattaaagacctcttggtgctaaaccctgaatattccaaaagggagaggacaatgctgcctgtcctcaaagaccagcaagagaaaaggcagtgacagaaagaaaatgccgacctgaaactggtgaggactttattcttttttttttgtagcatccaaaaaaggagtggtaggcctaagactatgacaaaatttaagtattgtcttagcttgggctgccacagtaaaataccatacactgggtggcttcaacaacaggaatttacttctggagactgtaagtcccagatcaaggtgttagcaggatcagtgtctggggagggcctctcctctggttccttgtagctcccttcttgctgtgttctcacatggcctttccacatgcatgtgagtggagagagggcagagggcagcaagcacccgagtttcttcttataaaggctctaatcccatcatgaggccccaccctcatgaccacatctaacctaattccctccccaaatgctccatctgcaaatatcacattcggggtgagggcttcaacataggaatttaggatgggggacacaattcagtccatagcaaatctaatttcctcaagaatttcagcatttaaaataaaatgccctggtttcgtgttcttatgaatgacctgtatcacacacttctgaggcagagagggtgacagactttgattttagtgccagtcttccctctcctaagtgagtgacttgggaagaaggatgttcgagggatgtagcctggccctcattcacacccaggccctccagctggaacaggtctgccccatcttcatcaccagaaaatccacaccagggcttcctttctacaggcagagctcgtttcttacatcacccacttgaagtcctgtatcacaggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaatttaatgtcctaataggtctggctgctcctctgccatctggcaggatgtatcatctgtggttttgagcttatcacctcctcaaaggagaatccccacttgtactcctgtttctatttgcgtatttaccagcgattccccagtgctttcatttaccttaaaatcacagtggacacattgtctcagccctggaggggttttgttttgttttgttttgttttgttttgtttttgaggagtctcgctctgtcacccaggctggagtgcagtggcatgatcttggctcactgcaacctctgcctcttaggttcaagcagttctcctgcctcagcctcctaagtagccgggattacaggcatatgccaccatgcctggctcatttttgtatttttagtagagacggccaggctggtctcgaactcctgacctcaggtgatccacctgtctcggcctccaaagtgctgggattacaggtatgagccactgtgctcagcccccagcgtttctcatatgagcatgtatatatatatatattatatatatattatatatgtttatatttatatatattatatataactgacagacctttctgatgtatattgttttatagttgttatttatgttgtatgctactatccaactattcatattcccattgcctatagatcaggggtcagcaaactacagtttgctggccaaatctggtccctgcctgtttttgtaagtacagtttaactgaaacacagctgcacccattgatttacatactgtctagagcagcttttgcactacaaatgataagaatttagtagttgcaacagagactggttcaaataggattggctgtgtttggaactagcacttgccagaatgtaatatttgctgtgaagtgctgaaaagaaaagtaacttccttttcatttttttagtggcatagtctaaaactgctcacaatccttttgaaagactaaagaataggccaggtgtggtggctcatgcctgtaatcccagcactttgggaggccaaggcaggcggatcacaaggtcaggagttcaagaccagcctggccaacatagtgaaacgctgtctctactaaaaatacaaaaaaaaatagctgggcttggtggcggccacctgtagtccccagctactcgggaggctgaggcaggagaatcgctggaacccgggaggcggaggttgcagtgagctgagatggcgccattgcactccagccctggagacagtgcgagactgtgtctc

SEQ ID NO: 10944 - DNA, 1776 bp, Homo sapiens
agtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgagcagggagaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaaccttt

SEQ ID NO: 10945 - DNA, 1500 bp, Homo sapiens
gtcacagccagggagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaa

SEQ ID NO: 10946 - DNA, 1446 bp, Homo sapiens
atgtttcgtgcgcttccattacggatcatacctcgcacctcaccgcgtggcctctgtagttccagagctcgcgagggccagggccgttggcggcggttggaacgaaacgatgagtgcctcctcgtggccccagaatggaatgccgccgtcgtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgta

SEQ ID NO: 10947 - DNA, 1766 bp, Homo sapiens
ggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttc

SEQ ID NO: 10948 - DNA, 1672 bp, Homo sapiens
gaattgtgcgggcgcggggaattatgggggtgggggctgggagggtctctcaaagtggggctccgagcccgggaggagcaggcagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcc

SEQ ID NO: 10949 - DNA, 1286 bp, Homo sapiens
ggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttc

SEQ ID NO: 10950 - DNA, 2160 bp, Homo sapiens
cgctacagaagattcaaactgagcaaatcgcctaatcttccaaattctttttcctggcttgttagagcagccaagggtggggtggagcttgtgaataaaaagcctgcttcatcttcctcatgcaggagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaa

SEQ ID NO: 10951 - DNA, 2155 bp, Homo sapiens
aggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaagtga

SEQ ID NO: 10952 - DNA, 1572 bp, Homo sapiens
tcattttgatctctgctaataccagagtcctgcgtggcagagccattggcaccagaaattacaagtacgtaaagagaacatggccaagcgagttgccattgtgggagctggggtcagcggcctggcctccatcaagtgctgtctggaagaaggactggagcccacctgctttgagaggagcgatgaccttggggggctgtggagattcaccaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacag

SEQ ID NO: 10953 - DNA, 757 bp, Homo sapiens
aggtttatccactgtgctggggactcccaagccagcactggctcatactgattcattttgatctctgctaataccagagtcctgcgtggcagagccattggcaccagaaattacaagtacgtaaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaa

SEQ ID NO: 10954 - DNA, 3851 bp, Homo sapiens
ttcagctggaagaatgctggaggaatacggaactcctcccatttctcacagccacctccaactcttaaaaacgcttccaactgcctcccagcacacaaccaagggagaaaactattctgtcaaagagacggtgccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtatggagaggttcaaaggccaatatttccatagccgccaatacaagcatccagatggatttgagggaaaacgcatcctggtgattggaatgggaaactcaggctcagatattgctgttgagctgagtaagaatgctgctcaggtttttatcagcaccaggcatggcacctgggtcatgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctattagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctagaagaaaaaacattacattcatgttctaattatagattttagagttaggtagtacaggtaagggggaaattgtaaagaattagcagaattaggcatatgtacaaaaccaaaattttgtcatgaaattttgcctttccacgcttccctcagttcaccaaagttaccaaaatgtaaaataaaataagactggctcaggtaagtagtgctgccaaccctgatataggggagttgtatggaaaaatagtagaattacacagcatgaaaagcagcccatggtttaaattattggacaatttaaattgtgggtaaatatttaaaactcctgaacaatgtttctgatggtcttctatccaccctacttggtaacaaagttctcagatgttaggtcatgtttcatttgctcagtcggggatcactcaaaactactagacaaaaaagtgagaggatagatttagaaaacatcagtgatgctcagataaacttttaggacctcatattaagagctaagcaaatggccacatttcctatattttgacagagatactgctggaaaaattaaaattaaaatgccataatagctacctaacaaatatatatgtttaatgtttatcataggccagacattgtgctatgtgcatatcatatgtattatttcatttaattctcacaacaattctgtgaaatggttacagctattatagtcatttcacagatgatgaaactaagattcagagcagctgatcttgtgaggcagctggaattggaactcagatttgttgaactctagaactaaagatcataatgttgtcttgtaatatatttatttacaaaacacttcattatttataaagaatttactaacagtttatcttatttatacccatacatctgctactttgggaggccctttacatagaaaacagcattctttttgccaaatatgaccaaattacttttatttataatttttgatttatatttcagctagatctaaaaagcatctgaaggaatttacaatgaaagatacctatgcaataacatttaggataatctttgacattttggaaaaataagaattgaggaaaaaaagtgtatctttcaagtagatgcaaagcattataatgactgacacttgtatctaactccagtcttacagataactaaggcaaaaagctaaataaacaatatgtaacctctaacatttggtaaaaggaagtatactggtctgttagcagagacaaactttttttagaattgaagtctgaaacaaacaaaagcaattcaatgtcaatagacattaagcaacataatagacaaacatctcctaagggaacatttgttacagctgctccttccctgaactgtgctttggaagataagctctgtcctgagtccaaaccaagcccttccaagagagaacaaaggtcagagatgttgaagattccagcaaatttctcctcttatttctaccaagcctttgtgaacattgctcttcattttggcctgtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaagttacaccagaatttacaggcaagattttttttttcattgctcccataagcaaatttgttttaaaataattgtaaatgaggtatatacttagttcttggttaaaaaatatattgctttgttaagtattaaagattatttgtaagtcattgtattaataatactaataaaatttatcaagcctttatagcaagggtcagtgaattaccactgcctgtgggccaaatctagctcactatctgtttttgtaaataaaattttataatagta

SEQ ID NO: 10955 - DNA, 5181 bp, Homo sapiens
tttctcacagccacctccaactcttaaaaacgcttccaactgcctcccagcacacaaccaagggagaaaactattctgtcaaagagacggtgccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtatggagaggttcaaaggccaatatttccatagccgccaatacaagcatccagatggatttgagggaaaacgcatcctggtgattggaatgggaaactcaggctcagatattgctgttgagctgagtaagaatgctgctcaggtttttatcagcaccaggcatggcacctgggtcatgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctattagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctagaagaaaaaacattacattcatgttctaattatagattttagagttaggtagtacaggtaagggggaaattgtaaagaattagcagaattaggcatatgtacaaaaccaaaattttgtcatgaaattttgcctttccacgcttccctcagttcaccaaagttaccaaaatgtaaaataaaataagactggctcaggtaagtagtgctgccaaccctgatataggggagttgtatggaaaaatagtagaattacacagcatgaaaagcagcccatggtttaaattattggacaatttaaattgtgggtaaatatttaaaactcctgaacaatgtttctgatggtcttctatccaccctacttggtaacaaagttctcagatgttaggtcatgtttcatttgctcagtcggggatcactcaaaactactagacaaaaaagtgagaggatagatttagaaaacatcagtgatgctcagataaacttttaggacctcatattaagagctaagcaaatggccacatttcctatattttgacagagatactgctggaaaaattaaaattaaaatgccataatagctacctaacaaatatatatgtttaatgtttatcataggccagacattgtgctatgtgcatatcatatgtattatttcatttaattctcacaacaattctgtgaaatggttacagctattatagtcatttcacagatgatgaaactaagattcagagcagctgatcttgtgaggcagctggaattggaactcagatttgttgaactctagaactaaagatcataatgttgtcttgtaatatatttatttacaaaacacttcattatttataaagaatttactaacagtttatcttatttatacccatacatctgctactttgggaggccctttacatagaaaacagcattctttttgccaaatatgaccaaattacttttatttataatttttgatttatatttcagctagatctaaaaagcatctgaaggaatttacaatgaaagatacctatgcaataacatttaggataatctttgacattttggaaaaataagaattgaggaaaaaaagtgtatctttcaagtagatgcaaagcattataatgactgacacttgtatctaactccagtcttacagataactaaggcaaaaagctaaataaacaatatgtaacctctaacatttggtaaaaggaagtatactggtctgttagcagagacaaactttttttagaattgaagtctgaaacaaacaaaagcaattcaatgtcaatagacattaagcaacataatagacaaacatctcctaagggaacatttgttacagctgctccttccctgaactgtgctttggaagataagctctgtcctgagtccaaaccaagcccttccaagagagaacaaaggtcagagatgttgaagattccagcaaatttctcctcttatttctaccaagcctttgtgaacattgctcttcattttggcctgtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaagttacaccagaatttacaggcaagattttttttttcattgctcccataagcaaatttgttttaaaataattgtaaatgaggtatatacttagttcttggttaaaaaatatattgctttgttaagtattaaagattatttgtaagtcattgtattaataatactaataaaatttatcaagcctttatagcaagggtcagtgaattaccactgcctgtgggccaaatctagctcactatctgtttttgtaaataaaattttataatagtacacagccacactcattcatttattttctgtggttgctttcaagctacaattgtagagttgggtagtcgcaacagaatctctgtggcccacaaggctaaaatatttacattctcacccattacagaaaaagtttgataattcctgctttataatatgtaaggcattgtcccattttgcataacttgccttatttcatcattatcactacccatttagtagctatggttgttatcttacttctacagtggaagagattgaaaagcatttgtcaggttaatgctaaatcagtgcggaaatatagctccactaggaaaatattattaaatttatatccctaaaatttttagaaatctctcaaaatctttccaaatgttctggtatctttgaaaaatgtaaatagtttatttatagagaaccctacctctgaggttgactcaaaggttaaagaaggctcatcagtctatccttctgcctccatatatcctgaacatcaaactatcccaggaaaaccatctagagtagtttgtttcaaaatattagccacagaccacctacatcacaataactcagggagcttatagaagtgaagattcctgaatataaacatagtaataattcaacctactgaatggaaatctctgctgaaatccacagttttcataagctccccagatgattcctgtgtacattaaatctagaaaccattagtttgagatctctcaaaaataaaaataaaaattgctttcagagagtagcccatgaaatttcccattcttcaaggacaaattccttctgttcagccttggtcctccaactgcagtttacaatttttgttcttctcctgtaaagaatgtcaatggttatcaccttcaatagtttcaatatgtcccccaaagttatgtgtttgaaacttgcaatagtattgggagatggggcctaatgaggtgattaggtgaagtctctgccctcatgaaaagattaatcccattatctcaggagtgtgttggttataaaagcaagtttggctccctcttttcctcacacactctttttcccttctgccttcacctttgccgtgggtggacacagcaagaaggccctcatcagatgctggccccttggtcttgaatttcctagcctctacaactaagccaaataaatttctgtttattataaataacccagtctcagatattctgttacagaaacacaaaatggactaagacaccacccttttccaaaatctctccttgtgatggctccctttactaacctttcttttagctattccctttatgatagtttcttaattttttctatcaaaagctaaatatggcacacttgttctttacagaaaaataaagatattttaaacaaaatactagggccatggtatgtaataaaatttgaaacaataatttcaaataataaagattgaaaatgcttaacccag

SEQ ID NO: 10956 - DNA, 2087 bp, Homo sapiens
gtaggctcactagaacattttctctttcaaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataa

SEQ ID NO: 10957 - DNA, 2066 bp, Homo sapiens
gtaggctcactagaacattttctctttcaaactgcccagacggttggacaggacgtagacacacagaagaaaagaagacaaagaacgggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataatt

SEQ ID NO: 10958 - DNA, 1508 bp, Homo sapiens
aaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcaacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctcta

SEQ ID NO: 10959 - DNA, 1822 bp, Homo sapiens
ctttcaaactgcccagacggttggacaggacgtagacacacagaagaaaagaagacaaagaacgggttaccatggggaagaaagtggccatcattggagctggtgtgagtggcttggcctccatcaggagctgtctggaagaggggctggagcccacctgctttgagaagagcaatgacattgggggcctgtggaaattttcaaggagccatgagtgaaggcgtacaagaggggtcttgccactgaaaaaaataagaaatgccagcatccaccagaagccagaagcggcaaggaatggattctctcctggagcctctgaaaatgaacatggaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctga

SEQ ID NO: 10960 - DNA, 2252 bp, Homo sapiens
agaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaagagatagagcacagcaaagatctgccagccccaggcctctacctagtggcctggaaattcaagtattcttattggtggaggccatttgtttctgattagaagctgtctaaacctcctactcctcaactcaaaggaaaacacagagcataccatggccaagaaagttgcagtgattggagctggtgtgagtggcctctcctccatcaaatgctgtgtggatgaggacctggagcccacctgctttgagagaagtgatgacattgggggattatggaagtttactgaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaagaccactgtgtgcagcataacgaagcgtccagacttctccgaaactggtcagtgggatgttgtcacagagacagagggcaagcaaaatagagctgtctttgatgctgttatggtttgcactggacatttcctgaatccccatttacctttggaagcctttcctggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggaaaaaagcaaaattcattgtgaatgatgagctgccaaactgtatcctctgtggggcaatcactatgaaaaccagcgtgattgaatttacagaaacctctgctgtctttgaagatgggacagtggaagaaaacattgatgttgtgatcttcactacaggatatacattttcttttccattttttgaagaacctcttaaaagcctctgtacaaagaagatatttctatacaagcaagtctttcccttaaacctagagagagcgacattagccatcatcggccttatcggccttaaaggatccatcttatcaggcacagagctccaagcacgatgggtcacaagagtattcaaaggactctgtaagatacctccatcccaaaaattgatgatggaggctactgaaaaggaacagctcattaaaaggggagtgtttaaagacaccagcaaagacaaatttgactacattgcctacatggatgatatcgctgcctgcataggcacaaagcccagcatcccacttctgttcctcaaggatcccagactagcttgggaagttttctttggaccatgtactccttatcagtaccgcctcatgggccctggaaaatgggatggagccagaaatgccatcctgacccagtgggacagaacattgaaacctttaaaaactcgaattgtccctgattcctccaagcctgcctccatgtcacattatttaaaagcctggggggcacctgtcctacttgcctctcttctacttatctgtaaatcttcacttttcttgaaattggtgagagataaactacaggacagaatgtccccttacctagtaagtctttggcgaggatgaacctgattgttacaagggttacacaaagtcatgctaattctatctccaagtatcttgtgcatccctcctctgctctccatcataactgctattagccaaattcaggcccagtcatctcctatctgaattattgtattatcttcttctttgttttcagtaccctctttcttgccaccctttccaatgcatcttctaccctgctacctcagtgattattctaaaataaatatatatgatatggttta

SEQ ID NO: 10961 - DNA, 2632 bp, Homo sapiens
aaaaaccaggaagttaaaagtggatgcagaagcgagcacagacggggctaggggtttcagagaaagtaattgagagtgctggcaacagcagctgaaatatagagaagttgtaggattaactttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccgtttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaact

SEQ ID NO: 10962 - DNA, 2168 bp, Homo sapiens
tgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaa

SEQ ID NO: 10963 - DNA, 1696 bp, Homo sapiens
aacagccgcctgttgagtctcctccagatcgcagctgaaggatctgttgagcgcttcaggaaaggcggtgagatccggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccgtttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaagtctaaccatgagaaaaacatcagacaaacccaagttgaagaatattctacaaatacctgactacctcaaaactgtcaagatcatcaacaaagaaagtctgagaaattgtcccggaataaaggggcctaaggagacataacatctaaatgtaatgtagtatcctggatggactcctgcaacagaaaaagaactttaagtaaaaattaagggaatattaataaagtatgcattttggttaataatgtatcaatattggtttattagttgtgacaaatgtaccagaggaatgtaaaatgtcaacaataaaggaaattggatgtggggta

SEQ ID NO: 10964 - DNA, 671 bp, Homo sapiens
aggaagttaaaagtggatgcagaagcgagcacagacggggctaggggtttcagagaaagacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggc

SEQ ID NO: 10965 - DNA, 618 bp, Homo sapiens
ctttttcggggagctcggctcttaagacgcgagtctgccgacgctcccggccgaataaaaacctcttccttttttaattcggtgtctgaggagttttgtctgtggctcatcctgctacaatctgtttgaacagatcacctgaaaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatgg

SEQ ID NO: 10966 - DNA, 4164 bp, Homo sapiens
cctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaa

SEQ ID NO: 10967 - DNA, 3975 bp, Homo sapiens
agcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacaggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatt

SEQ ID NO: 10968 - DNA, 3795 bp, Homo sapiens
ctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatt

SEQ ID NO: 10969 - DNA, 1912 bp, Homo sapiens
ggcggggcgaagtgggggtgcttagtccgttgcggggggcggggtcgcgtctgccgcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 10970 - DNA, 1912 bp, Homo sapiens; identical to SEQ ID NO: 10969

SEQ ID NO: 10971 - DNA, 1912 bp, Homo sapiens; identical to SEQ ID NO: 10969

SEQ ID NO: 10972 - DNA, 457 bp, Homo sapiens
agggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagctt

SEQ ID NO: 10973 - DNA, 592 bp, Homo sapiens
ctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagat

SEQ ID NO: 10974 - DNA, 592 bp, Homo sapiens; identical to SEQ ID NO: 10973

SEQ ID NO: 10975 - DNA, 856 bp, Homo sapiens
gatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaa

SEQ ID NO: 10976 - DNA, 592 bp, Homo sapiens; identical to SEQ ID NO: 10973

SEQ ID NO: 10977 - DNA, 592 bp, Homo sapiens; identical to SEQ ID NO: 10973

SEQ ID NO: 10978 - DNA, 457 bp, Homo sapiens; identical to SEQ ID NO: 10972

SEQ ID NO: 10979 - DNA, 678 bp, Homo sapiens
ggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 10980 - DNA, 792 bp, Homo sapiens
gaaaggatgggcccctgtggacgccacagcgcgccttccccatccgcaaaggctttccctccctctcctccagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgac

SEQ ID NO: 10981 - DNA, 856 bp, Homo sapiens; identical to SEQ ID NO: 10975

SEQ ID NO: 10982 - DNA, 416 bp, Homo sapiens
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagat

SEQ ID NO: 10983 - DNA, 629 bp, Homo sapiens
gagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagaga

SEQ ID NO: 10984 - DNA, 367 bp, Homo sapiens
agggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 10985 - DNA, 968 bp, Homo sapiens
gtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 10986 - DNA, 457 bp, Homo sapiens; identical to SEQ ID NO: 10972

SEQ ID NO: 10987 - DNA, 629 bp, Homo sapiens; identical to SEQ ID NO: 10983

SEQ ID NO: 10988 - DNA, 717 bp, Homo sapiens
gaaaggatgggcccctgtggacgccacagcgcgccttccccatccgcaaaggctttccctccctctcctccagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 10989 - DNA, 851 bp, Homo sapiens
ggcggggcgaagtgggggtgcttagtccgttgcggggggcggggtcgcgtctgccgcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 10990 - DNA, 888 bp, Homo sapiens
tggggctgccgagaagcagggagagaggggaaaggtctgcaggcctctgggcgcgggggacctttatcaaagggagcggcgaggggaagggagggaccatacgcaggcggagaagagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagc

SEQ ID NO: 10991 - DNA, 581 bp, Homo sapiens
gatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 10992 - DNA, 547 bp, Homo sapiens
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagc

SEQ ID NO: 10993 - DNA, 347 bp, Homo sapiens
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagaga

SEQ ID NO: 10994 - DNA, 792 bp, Homo sapiens; identical to SEQ ID NO: 10980

SEQ ID NO: 10995 - DNA, 1912 bp, Homo sapiens; identical to SEQ ID NO: 10969

SEQ ID NO: 10996 - DNA, 495 bp, Homo sapiens
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgac

SEQ ID NO: 10997 - DNA, 457 bp, Homo sapiens; identical to SEQ ID NO: 10972

SEQ ID NO: 10998 - DNA, 888 bp, Homo sapiens; identical to SEQ ID NO: 10990

SEQ ID NO: 10999 - DNA, 888 bp, Homo sapiens; identical to SEQ ID NO: 10990

SEQ ID NO: 11000 - DNA, 246 bp, Homo sapiens
gactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagctt

SEQ ID NO: 11001 - DNA, 629 bp, Homo sapiens; identical to SEQ ID NO: 10983

SEQ ID NO: 11002 - DNA, 888 bp, Homo sapiens; identical to SEQ ID NO: 10990

SEQ ID NO: 11003 - DNA, 629 bp, Homo sapiens; identical to SEQ ID NO: 10983

SEQ ID NO: 11004 - DNA, 856 bp, Homo sapiens; identical to SEQ ID NO: 10975

SEQ ID NO: 11005 - DNA, 1912 bp, Homo sapiens; identical to SEQ ID NO: 10969

SEQ ID NO: 11006 - DNA, 592 bp, Homo sapiens; identical to SEQ ID NO: 10973

SEQ ID NO: 11007 - DNA, 792 bp, Homo sapiens; identical to SEQ ID NO: 10980

SEQ ID NO: 11008 - DNA, 182 bp, Homo sapiens
gtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaa

SEQ ID NO: 11009 - DNA, 856 bp, Homo sapiens; identical to SEQ ID NO: 10975

SEQ ID NO: 11010 - DNA, 792 bp, Homo sapiens; identical to SEQ ID NO: 10980

SEQ ID NO: 11011 - DNA, 1481 bp, Homo sapiens
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 11012 - DNA, 34 bp, Homo sapiens
gtggccaagactaagcagcagattgaggagcagc

SEQ ID NO: 11013 - DNA, 888 bp, Homo sapiens; identical to SEQ ID NO: 10990

SEQ ID NO: 11014 - DNA, 792 bp, Homo sapiens; identical to SEQ ID NO: 10980

SEQ ID NO: 11015 - DNA, 629 bp, Homo sapiens; identical to SEQ ID NO: 10983

SEQ ID NO: 11016 - DNA, 457 bp, Homo sapiens; identical to SEQ ID NO: 10972

SEQ ID NO: 11017 - DNA, 856 bp, Homo sapiens; identical to SEQ ID NO: 10975

SEQ ID NO: 11018 - DNA, 1380 bp, Homo sapiens
gtctgccgcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgt

SEQ ID NO: 11019 - DNA, 629 bp, Homo sapiens; identical to SEQ ID NO: 10983

SEQ ID NO: 11020 - DNA, 695 bp, Homo sapiens
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaa

SEQ ID NO: 11021 - DNA, 761 bp, Homo sapiens
tggggctgccgagaagcagggagagaggggaaaggtctgcaggcctctgggcgcgggggacctttatcaaagggagcggcgaggggaagggagggaccatacgcaggcggagaagagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 11022 - DNA, 592 bp, Homo sapiens; identical to SEQ ID NO: 10973

SEQ ID NO: 11023 - DNA, 1380 bp, Homo sapiens; identical to SEQ ID NO: 11018

SEQ ID NO: 11024 - DNA, 1380 bp, Homo sapiens; identical to SEQ ID NO: 11018

SEQ ID NO: 11025 - DNA, 1380 bp, Homo sapiens; identical to SEQ ID NO: 11018

SEQ ID NO: 11026 - DNA, 1380 bp, Homo sapiens; identical to SEQ ID NO: 11018

SEQ ID NO: 11027 - DNA, 1199 bp, Homo sapiens
aggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttccta

SEQ ID NO: 11028 - DNA, 2713 bp, Homo sapiens
gtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagactgtctctggaggttatgaccatcctgtgtcgctgtgagaatattgagacgtcggagggggttccactattcgtaacaggggttgcacaggtcccttgcccttgcctattggactgcaagtggggaaacagcaagggattctggaagctctgccaagtctgccagatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccc

SEQ ID NO: 11029 - DNA, 2548 bp, Homo sapiens
gtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccc

SEQ ID NO: 11030 - DNA, 3842 bp, Homo sapiens
acctgcagcgcgaggcgcgccgctccaggcggcatcgcagggctgggccggcgcggcctggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaaccccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtccccaca

SEQ ID NO: 11031 - DNA, 3848 bp, Homo sapiens
acctgcagcgcgaggcgcgccgctccaggcggcatcgcagggctgggccggcgcggcctggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgtgaggctggcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaaccccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtcccc

SEQ ID NO: 11032 - DNA, 3178 bp, Homo sapiens
ctccaggcggcatcgcagggctgggccggcgcggcctggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcggcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggc

SEQ ID NO: 11033 - DNA, 2635 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 11034 - DNA, 2697 bp, Homo sapiens
agatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 11035 - DNA, 2192 bp, Homo sapiens
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttataattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 11036 - DNA, 2403 bp, Homo sapiens
ggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 11037 - DNA, 1896 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacagaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagacattttagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaaaaagaaa

SEQ ID NO: 11038 - DNA, 2225 bp, Homo sapiens
ccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagagga

SEQ ID NO: 11039 - DNA, 1107 bp, Homo sapiens
tggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcac

SEQ ID NO: 11040 - DNA, 947 bp, Homo sapiens
tccgcattccttggtgccactgaccacagctctttcttcagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcaca

SEQ ID NO: 11041 - DNA, 1331 bp, Homo sapiens
ggaaaggattttctcagcccccatccccagcactgtgtgttggccgcacccatgagagcctcagcactctgaaggtgcagggggcaaaggccaaaagagctctggcctgaacttgggtggtccctactgtgtgacttggggcatggccctcatctgtgctgaaatgattccacaaagattaaactggctatcatttgttgatttcccccttcttacatttaatccttgcaggagaaagctaagcctcaagatagtttgcttctctttcccccaaggccaaggagaaggtggagtgagggctggggtcgggacaggttgaacgggaaccctgtgctctaaacagttagggtttgttcccgcaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgc

SEQ ID NO: 11042 - DNA, 1061 bp, Homo sapiens
actaaaccacagctgtcccctggaataaggcaagggggagtgtagagcagagcagaagcctgagccagacggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgc

SEQ ID NO: 11043 - DNA, 1138 bp, Homo sapiens
ctaagtagggagatttcactcagtgcttaccagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 11044 - DNA, 1120 bp, Homo sapiens
atttcactcagtgcttaccagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcgccacttcatccaggacacctgtctctatgagtgctcaccctggggccctggatccagcaggtgaatcagagctggcgaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataattcc

SEQ ID NO: 11045 - DNA, 610 bp, Homo sapiens
aggctgtggggacagcctaggggcctggatctattgcctacttagagagaggccaactcagacacagccgtctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctt

SEQ ID NO: 11046 - DNA, 2176 bp, Homo sapiens
ctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaaagttttactatggctgaataagaatgggattcaagaaatacacaactgtgcattcaatggaacccaactagatgagctgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtcttgcctttgaagggtatgtcacaaagagctgacagtgcttctacacatttcatctaa

SEQ ID NO: 11047 - DNA, 2588 bp, Homo sapiens
agttctcaagtcagatctcttctcataagggcactgtgtggagcttctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaaagttttacttgacattcaagataacataaacatccacacaattgaaagaaattctttcgtggggctgagctttgaaagtgtgattctatggctgaataagaatgggattcaagaaatacacaactgtgcattcaatggaacccaactagatgagctgaatctaagcgataataataatttagaagaattgcctaatgatgttttccacggagcctctggaccagtcattctctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtcttgcctttgaagggtatgtcacaaagagctgacagtgcttctacacatttcatctaatttaatattcctggcatacctttaaggtaaattggtcaggaactattaattccatgtgatacattaggaagctgaattattagtaacaacaataataattaaagaatgcaatactgtattacatattttatccttatatatgttatttttgcacgttatgttcaaagtgcttttgttcagatatctcaagtgatccctgttaaataagcaggacagggattattcttggagttttacaaatgaggaaaccacgactcaaagagttaagtgacttgttcaaaattgtttagtttgtaagaggcagagccaggattaggtattccgactcccagagaatttcccagagaagcaccatggtattcattcattcattcattcaacaaatattaattgaacacccatctgaagcctttgtaatgcgtcagtgtggataggctgaaatacatttcccagatttcccttcctcatgtgttt

SEQ ID NO: 11048 - DNA, 2784 bp, Homo sapiens
tgaccctaccagttctcaagtcagatctcttctcataagggcactgtgtggagcttctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaaagttttacttgacattcaagataacataaacatccacacaattgaaagaaattctttcgtggggctgagctttgaaagtgtgattctatggctgaataagaatgggattcaagaaatacacaactgtgcattcaatggaacccaactagatgagctgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtcttgcctttgaagggtatgtcacaaagagctgacagtgcttctacacatttcatctaatttaatattcctggcatacctttaaggtaaattggtcaggaactattaattccatgtgatacattaggaagctgaattattagtaacaacaataataattaaagaatgcaatactgtattacatattttatccttatatatgttatttttgcacgttatgttcaaagtgcttttgttcagatatctcaagtgatccctgttaaataagcaggacagggattattcttggagttttacaaatgaggaaaccacgactcaaagagttaagtgacttgttcaaaattgtttagtttgtaagaggcagagccaggattaggtattccgactcccagagaatttcccagagaagcaccatggtattcattcattcattcattcaacaaatattaattgaacacccatctgaagcctttgtaatgcgtcagtgtggataggctgaaatacatttcccagatttcccttcctcatgtgttt

SEQ ID NO: 11049 - DNA, 1867 bp, Homo sapiens
agttaaatatgagagttaaatacttctagttttgaaaatgtgagatcgaaaaggcaagaaaccaggctttcctactgtctcacataatttcttacacaaaatcattttacagagagaaactgagactctgaaaaggttaatatccaacacaggtattaagcaccttccagatgttcacaagattcattctctccaaaaagttttacttgacattcaagataacataaacatccacacaattgaaagaaattctttcgtggggctgagctttgaaagtgtgattctatggctgaataagaatgggattcaagaaatacacaactgtgcattcaatggaacccaactagatgagctgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgt

SEQ ID NO: 11050 - DNA, 6388 bp, Homo sapiens
atggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatatagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtctcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagtccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcttaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttga

SEQ ID NO: 11051 - DNA, 3845 bp, Homo sapiens
atatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttg

SEQ ID NO: 11052 - DNA, 1720 bp, Homo sapiens
tatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggtatgtaatctgacaactgttacactatgtattagacttttttgtagctatctgtaattattttatagcaaaaccaaaaataaataaaatgcttttacctcctgca

SEQ ID NO: 11053 - DNA, 6589 bp, Homo sapiens
gccccgccccgcgcgccgtggccgtttgaagtgactaatttctgtcatatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtctcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagtccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcttaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttg

SEQ ID NO: 11054 - DNA, 6925 bp, Homo sapiens
gcggccgccgcccccggctgcgcgctgagccgccggccccccgagcgccacggccggagctgcggcggcggcatcatggccccgaccctgctccagaagctcttcaacaaaaggggcagcagcggcagctccgcggcggcgtctgcccagggcagggctcctaaggaaggacccgcctttagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatcatccagtcctggatgagccaatagctgaagctgtctgtattatcgcagacacggataaatggagtgtgcaggtagctacaagtcagaggaaagtgacggacaacatgaaactaggccaggatgtcctggtctctagtcaggtgtccagtttgcttcagtccattttacagctctataagcttcacctccctgctgatttttgcatcatgcatcttgaagatagactacaggagatgtaccttaaaagtaaaatgctatctgaatatctccggggacacacacgagtccatgtgaaagaattaggtgtcgtactggggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatccttttcaaaacatctttccagacattaacttacacattgtataaaaccgaccaaaatgatttcctaaagttcatgcaaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaagttttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaatgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttga

SEQ ID NO: 11055 - DNA, 5670 bp, Homo sapiens
atgtgcggcggcacagcgaacaccacaaaccagccagagagctggcaagactctgccagatgtgtgagtgatgctgttcctggtgctgggaggatttacagggcgcttttatgcacaaagattaaaaaacacaccggagtagacaggagcactgaccacacggaactcgacaacagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatcatccagtcctggatgagccaatagctgaagctgtctgtattatcgcagacacggataaatggagtgtgcaggtagctacaagtcagaggaaagtgacggacaacatgaaactaggccaggatgtcctggtctctagtcaggtgtccagtttgcttcagtccattttacagctctataagcttcacctccctgctgatttttgcatcatgcatcttgaagatagactacaggagatgtaccttaaaagtaaaatgctatctgaatatctccggggacacacacgagtccatgtgaaagaattaggtgtcgtactggggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatccttttcaaaacatctttccagacattaacttacacattgtataaaaccgaccaaaatgatttcctaaagttcatgcaaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaagttttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagc

SEQ ID NO: 11056 - DNA, 2173 bp, Homo sapiens
gcttttctcacatactgtatagggagtgaaatgattgtttagaactgctggtcattacagaatgttcctcacataacaaaggaacttcaggatttgtctccaagtccatgtttatggtcaggataaaccagaagaacattaaaccgttcaggagatgtgcggcggcacagcgaacaccacaaaccagccagagagctggcaagactctgccagatgtgtgagtgatgctgttcctggtgctgggaggatttacagggcgcttttatgcacaaagattaaaaaacacaccggagtagacaggagcactgaccacacggaactcgacaacagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggg

SEQ ID NO: 11057 - DNA, 722 bp, Homo sapiens
ctgccatggaccccgcgcccggcgtcctagatccccgcgccgcgccgcccgcgctcctgggcaccccgcaagccgaggtgctggaggacgtgttgcgggagcagttcgggccgctgccccagctggccgctgtctgccggctcaagcggctgccctcgggcggctactcgtccactgaaaacctccagttggtgctggagcggcggcgtgtggccaacgccaaggagcgtgagcggataaaaaatctcaaccgtggttttgccagattgaaggcacttgtgccatttcttccccaaagcaggaagcccagcaaagttgatatccttaaaggtgcgactgaatatatacaggttctcagtgatcttttggaaggagccaaagactcaaagaaacaagacccagatgagcagagctatagtaacaacagttctgaatcacatacatcctcggcaagacagctgtcaagaaacatcacccaacatatcagctgtgctttcggcttgaagaatgaagaggaagggccttgggcagatggtggcagtggtgagccagcacacgcttgtcgccacagtgtgatgtctacgactgaaattatctccccaaccagaagtctggatagattcccagaagtagaactgctgagtcacagacttccacaagtatgaaaaatgaaaaggcccagggttaccttctagagacaaataaatgcagtcttgaaagtt

SEQ ID NO: 11058 - DNA, 2519 bp, Homo sapiens
gatttcgggcacctccgaaagataattgggaagggtttccagaaggtgggaaatgtcacctgattcacactgaacttttgaaagctccccacccccaaggagccgcgcacaccctcgctcgcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaa

SEQ ID NO: 11059 - DNA, 1357 bp, Homo sapiens
atggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgaatctgcccgtaaaacctgagccattgattcttcagaactttctgcagtttttgacttcatagattatgctttaaaaaaatttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaa

SEQ ID NO: 11060 - DNA, 1023 bp, Homo sapiens
atggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactacaccgaggaagaggaggaagatgaagaccaggactacagctttcctatatcttctattctagagtggtaa

SEQ ID NO: 11061 - DNA, 5943 bp, Homo sapiens
ggcagggacccacgggacaccccctctgcctccgctccacgtccagggggccgaaggggcgccggacgagggaccgtgcggagagaggggttcggcggcgccaggactcccgcgggctccccggagcaggggtcggaaggagggggagcgggagccgcgggggccgctgcagcagaagggggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatggttttattggtttcctttcccccaattaaggccaaataaagtcgtgagaacattacccatttacttcctaagagtggatttgagtttcaggagccttaaaaaggactgaagagtttctcctgggactacagcttggatggaaagtttactcggggactggtagaacaagtttctttgaaaggatcatggatagtgggtctggagtagaaggtgatgacaagtcagaaagtgtcttagtcccttcaagttgctataacaaaatgcctcagactgggtaattataggcaacagaaatgtattgctcacagttctgaaggctgggaagcctaagatcaaggtaccagcagattcagtgtctgatgacggcttgttgaagcttgcctgcttcaaagaatgcacctttttgatgcatccccacatggtgaaaagggtgaacaaactcccttaggcctcttttataagggcacttacccattcatgagggttaaactttgatgacctaatcatctcccaagagcctcacctctcaataccattgctttggggattcaattttaacatatgaattttgggggacataaacattcaaaccatagcaggtgcattcctgtattgggaagacattaaattaaatgactcgtaaatcccccatatgatttaggagactaaatggcatccagtgaggctgactgcagtagcctgtgagaaggcaaataaacatgggaaggtagtacagggaacatggaatcattgccagggacaggctaaataaccttaatggcacttccttgatacacacattccatgggggtaaacagttccaagtgggctgaacgttagctggttaaaacctcttttgcttggggacacatgactaacgctttccaacctgccattttcatatgtatcatgcactctccacccacaataattctgcctcccaaaagagcatattatagtcaatgaggtttaaggtttcttcggttcagtcatgtggaagttttgctttcctaaaattatagctggatcactttgattggatttgggatattacccaaatgctaatcaaatattaaaaggcaatcttttttgttatgtgattgctacagattactgctcttacagtttgattcttcaaattttcattctcagaagggaatcttaaacccagtttgaagggtaccttgtccacaaccacttttaaattttggctaacttcccaaccttccaccatgttctgggaaaactttttctgctgttatagtatgtatgtattcaggaagtgcaacattattaaactaagcataattcagaagctaagtttcctttcatcaaaatttaatattacgaattgtgcaaagaagtatgttactttgatcagctttattttagagcttctttatcaagttatcatcagtcctcttgaattatttctgaaataaggggaaggaaggaagggaaaaaatatgaatgcatagatagatctaagcagatgccttcagagccctggaataatcctagctgggatatgggacatgaaaacaactctggcctactgctgctgggggctgttgcatggtgtgacataggaagtaaaatgttgctgtatgaataggaaggagggtcttcctgtcaatgagaattaatgttttcctaatgatttaacttttttactgaaaaaataatatgtgtacatggtaaaaatccaaattgtatcacagaaaatacagtgaataaaaccatcctcttaagagggtgtgtacatttataaatttgcctatgattgcctataaagtcaaagaagttgcaccagtatgcatgactgccaaaagtacataaactgagcatatccatttccctacattcttgcaaacattgtgccttcgaactttttggcctctgatagaggaaaaatggtaactccttgttttattttttatattcattattccttttgtaagattaaatatcatctcatgaataa

SEQ ID NO: 11062 - DNA, 565 bp, Homo sapiens
ctccgaggctggcgatcggcggagctcccacctccgcttacagctcgctgccgccgtcctgccccgcgcccccaggagacctggaccagaccacggtcagcgcggggcccggcgccttcagactcgctctcttctctcttccgcagatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctc

SEQ ID NO: 11063 - DNA, 1506 bp, Homo sapiens
atttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtt

SEQ ID NO: 11064 - DNA, 2511 bp, Homo sapiens
gggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccattt

SEQ ID NO: 11065 - DNA, 2278 bp, Homo sapiens
tgggggtggggacagggaccaggaagttgggcccgggccgccggggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaag

SEQ ID NO: 11066 - DNA, 1383 bp, Homo sapiens
ggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagc

SEQ ID NO: 11067 - DNA, 2339 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaagccttcgactgacccttgaccccctgctccctcagcagagacggagggaggggctgctggtggtcagggacctgcactgtgtagagggagcctggctgtgtggcctggaacaagtccctccctccctgtgcgcctcaggtggcctgtctgtgagatgagaagaagaccagactgaagcctgttcaccatatgccaggcagtgctttct

SEQ ID NO: 11068 - DNA, 2274 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 11069 - DNA, 2109 bp, Homo sapiens
gtctcccgcccgggcctagagcgctgccgggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctggga

SEQ ID NO: 11070 - DNA, 677 bp, Homo sapiens
cagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagccca

SEQ ID NO: 11071 - DNA, 959 bp, Homo sapiens
ggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacg

SEQ ID NO: 11072 - DNA, 2420 bp, Homo sapiens
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagac

SEQ ID NO: 11073 - DNA, 2401 bp, Homo sapiens
gctagaggggctgcttgcgccaggcgccggccgccccactgcgggtccctggcggccggtgtctgaggagtcggagagccgaggcggccagaccgtgcgccccgcgcttctcccgaggccgttccgggtctgaactgtaacagggaggggcctcgcaggagcagcagcgggcgagttaaagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacat

SEQ ID NO: 11074 - DNA, 2422 bp, Homo sapiens
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacat

SEQ ID NO: 11075 - DNA, 1128 bp, Homo sapiens
agtatgctgggagcggtgaagatggaagggcacgagccgtccgactggagcagctactatgcagagcccgagggctactcctccgtgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtg

SEQ ID NO: 11076 - DNA, 1988 bp, Homo sapiens
ggagcccggggcgggcgagggcgggggtgtcccggctataaagcgtggccgcctcccgcggcgctcgggacagccgtaccccgggcggtcggacgggcgggcgccggtgggagctcgggccgtgcccgctgagagatccagagcgctccgttcccccggggccggagcgggggcgggtgggggcgtaagcccgggggatgctgggctcagtgaagatggaggcccatgacctggccgagtggagctactacccggaggcgggcgaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccgggcaagatgctgaccttgagtgaaatctaccagtggatcatggacctcttcccttactaccgggagaatcagcagcgctggcagaactccattcgccactcgctgtctttcaacgactgcttcgtcaaggtggcgcgttccccagacaagcctggcaagggctcctactgggccctacaccccagctcagggaacatgtttgagaatggctgctacctgcgccgccagaaacgcttcaagctggaggagaaggtgaaaaaagggggcagcggggctgccaccaccaccaggaacgggacagggtctgctgcctcgaccaccacccccgcggccacagtcacctccccgccccagcccccgcctccagcccctgagcctgaggcccagggcggggaagatgtgggggctctggactgtggctcacccgcttcctccacaccctatttcactggcctggagctcccaggggagctgaagctggacgcgccctacaacttcaaccaccctttctccatcaacaacctaatgtcagaacagacaccagcacctcccaaactggacgtggggtttgggggctacggggctgaaggtggggagcctggagtctactaccagggcctctattcccgctctttgcttaatgcatcctagcaggggttgggaacatggtggtgggtatggctggagctcacaccacgaagctcttggggcctgatccttctggtgacacttcacttgtcccattggttaacatctgggtgggtctattacttactgtgatgactgctgtctcagtgggcatggtgttgatccacggggtactgtgataaccaccatggatacattttggtggcccactgggtactgtgaggactgctacattgatggatgttattggctaatccactgcatggtttgatggccaccatctcggttggccctttgggtgtgatggtgatagcatttcagtgacatcttctttggccccccccattaggtgctgtgcccacttcttttttggtgtacttggcacagtaggtgccaagttggccaccattctgtgtaacaccttttttggcccattgggtgctttgatggacatcatactgggtaggtgacaacgtcagtgggccaccatgtgccatgatggctgctgcagccccgtgttggccatgtcgtcaccattctctctggcatgggttgggtaggggatggaggtgagaatactccttggttttctctgaagcccaccctttcccccaactctggtccaggagaaaccagaaaaggctggttagggtgtggggaatttctactgaagtctgattctttcccgggaagcggggtactggctgtgtttaatcattaaaggtaccgtgtccgcctctt

SEQ ID NO: 11077 - DNA, 3447 bp, Homo sapiens
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtc

SEQ ID NO: 11078 - DNA, 748 bp, Homo sapiens
ccatgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttga

SEQ ID NO: 11079 - DNA, 4675 bp, Homo sapiens
cccttggtcagaggtcccagagggggcccaggcgacttcctctcaaaggacatgagtagtcagacctgccttccatttttttctgcccttaccttggggggatgaagaactctattttgaggattctgtgaaaagggttgcaacccaactctgttctatttctttgcaggagcctgggtgagttctttctccctatcctgggcctctgtagctccatctgtggaatgggagagttggattaacaccaggctatcccgtagattggaggctgctgttagatgaaactgcaaagtgttctcagtaccctttcctaaatggcctagaatatggctacacttatacatcagttctgaggtaggtgttactagcctcatttttacaaaggcagaaacaaagcgcaaagaaccttgcccaaggtgacagatagggtaagtagtgaaggcaggattggaaccccaggagcctgacttaaggtcgctgctcttaactactatgcagaccaggaaactgaggctccgaagcggggaagtcacctaatgagggtcacacagccttgctacagcggaggcagctgggattccggcctcgcacgcccgagctttagccactgtgcggcgctgtcggggcagcagcccaggcatccgctcagttcctgctcacgtccagcgcccatctccccttccgtgccccagaggctgaaatgggcccaatctgtgttgaagctgcttgtttctgggtcctggagggaggccgggggagaaagaggtctaataggatgggcaggaacccggctagcgagaaacaaggcacagggccaaccttagttgcacaagacttttgagagatgaaggcaacacttggtggaggtcagggttcactgagggggtgtcgggcagggggcggaggaggtcctgccgcctgtcggtggggcccagaaccctgggagccaggaaggtggggggtgtccagtcctcagggcaactggggccagggagaggggagggagaaattaagcggattcccagacccatgaacagacatccagacaaatgccgtttccacagagactcacggagagtgagatagtcacagagactgagacaaacggatgccgagatccagagggtcggagaacaggcaaactcggagcagtagaccggcccgcgccccgggaacgcggccacagcggccggcgctctgcccggcctctccgcgcggagaggggtggcgggcccgacagcggagggaggagagggcgccgccgcaatctcacctctcccaggcccaaggctgcgggcgccaagttcgctcctggtgatcactcgaatgcgtctcccctcgggctggaagccgtgcgggctcgggtgggcgccggcgggccgcgctggggcggcgtgggtcccggcgtctcagcctcgcgctcccactgcgcttcggcccggtggcccgggcgccgccttggggagaggacgggtggggaccgccgccacttccctggctgcggctggcgcccgagtgagccttaacatccaggggctgagcgttctgaaggcggcggcttcagggagcacagggtgcaggagcggcggcgaagacaagggcccgcctccggccactcgagcccagctcccgccgcggcggcggtttgttcccgccgggtccctcagcggaggcgctacgcccgcccctgtcgcctcgccccaccccgcccagggagctccgccctagcccgcagctcttccgccttaggcagccgctaggcgggagggacaatcccccaccaccaaccactgccaccccgaggggactaggggctgaggcccgcccaggtaagggaaagcctcagctccttccgttgcgccccagcggcgggtcccagctcggattcccggggtagtggcgggggccgccggcgggtcgtgccctggaaggtgagcgcggccgagctgggccgccagggggcgctgcggagccgggggacacccctccctgcctgcctcagtcccccgccccctccccgcccgcgcgcaaaacgcactcgccccagaggcagcgcggccgagcccgagccgctgccggagcggagccggagagtggcggcggcggcggcagcggcaccatgaccctgggcagctgctgctgcgagatcatgtcctccgagagctccccggccgcgctgtccgaggccgacgcagacatagacgtggtgggcggcggcagcggcgggggggagctcccagctcgctccgggccccgcgccccccgggacgtgctcccccacggccacgagcctcccgcggaggaagccgaggcagacttagccgaggacgaggaggagtctggtggctgctcggacggcgagccccgcgctctggcgtcccggggggcggcggccgcagcggggagcccggggccaggcgccgcggcggcccgcggcgcagcggggcccgggccgggaccgccgtcggggggcgcggcgacgcggagcccgctggtgaagccgccctactcgtacatcgcgctcatcaccatggccatcctgcagagccccaagaagcggctgacgttgagcgagatctgcgagttcatcagcggccgcttcccctactaccgggagaagttccccgcctggcagaacagcatccgccacaacctctctctcaacgactgcttcgtcaagatcccccgcgagccgggcaacccgggcaagggcaactactggacgctggacccggagtcggccgacatgttcgacaacggcagcttcctgcggcgtcgcaagcgcttcaagcggcagcccctgccgccgccgcacccacacccgcaccctcacccggagctgctgctgcgtggcggggccgcggcggcgggggatcccggcgctttcctgcccggcttcgctgcctacggcgcctacggctacggctacgggctggctctcccggcctacggcgcacccccgccggggccggccccgcatccgcacccgcacccgcacgccttcgctttcgccgcggcagccgccgccgctccttgccagctgtcggtacccccaggccgcgccgccgcgcctccacccggacctccgacggcctcggtgttcgcaggcgcgggatcggccccagctcctgcgcctgcctcaggctcgggcccgggcccgggccccgcaggcctgcccgccttcctgggcgcggagctgggctgcgccaaagccttctacgcggcgtccctgagtcctcccgcagccggcaccgcggcgggtctgcccaccgcacttctgcgccagggcctcaagacggacgcgggcggtggtgcaggcggcgggggcgccggggcagggcagaggccttccttctctatagaccacatcatgggccacggtggcggcggggcagcacccccgggcgccggcgagggctctccgggaccgccattcgcggcagccgcgggtcctgggggccaagcccaggtcttggccatgctgactgctccggccctggctcccgttgctggccacattcgcctctcgcatcccggggacgcgctgctgtcctcagggtcccggtttgccagcaaagtcgccggccttagtggctgccacttctgaccgcagcaggcccagggccggttaggtccgcactcctcagcctctcccgggagttcctgcggtcccagcggaactcagggagtctatttatgaagtctccagaccttgggccggcacgcgtgacacggcacttcaggctccacgcacagaatctcgcagatagttgggactaagcgggctctatcgctcagggcgacaggcccggggctacgcgaagaagtcgcaggccaagattctttacagtttgagaaataaaagcaggggggtgggggcttcgtttttttccctgcctctgcgcctctcggggaacacattccgggagagatgcctggccaggctccacggatcccgccagaaacaccaacagagggtctccctttctgcctttcccctctcacttcttccccaacgttgagaccctgcttgtccaatattataatttaaagacatctattatctgctttgtgcttaaaagaaaaattcaacctttttttttttttttttttttttgctgttctccaaggaagttcgtttcctctgaagcctaaaccagtgtctacgcaggcggagctgaacggagaggtgaagcagggggtctttatattccctgcagaaaccctggatcccactccactgaggaaaatcctttctcttttgtgtttgggtgcttttaaaggaatttctttcctttcccttggctggctgggtccagccatctccggccagcaaccctgtcagtgttccaccctgtcccaggccctgtgatatttattgtggctaaaggcaatgagattgggtggaagagaagggtctgggccagggactggagaggtgggggtggagtgggcaagggcacaccctgtggcagggggtcctataattttgtgtaaatatctgtacagcgcgctgctctcggcgttctctgtccactgggtgtgcattgatttaaacttctccactgtggggaagctctgtgaaatcgtctgatggtctgtgtggaagaaaagaaaaatctgtctgccgcctatttcccattggtgtcgattgaataaatgtatgtgaacttca

SEQ ID NO: 11080 - DNA, 2068 bp, Homo sapiens
atgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagtaccgtggggatgggagggaaattctttgtatatatttgtaaaaaaattattgactttccttttggggtttttatttttttaagaaaaaacaaattccgtagatttagagctctgaactttcattttttttgaaggttcactctccgaagttttatctgagaaaagaatgtatagagacgttgggagattttaaatataaaaaattttcaaaaaggcaaaaagtgtcattctattataaaagtctgtttatatatgaatgaatatatatggtattctaaatgttattccatcgtgttgtacacaactttgtaaataaatttttaaaatgcc

SEQ ID NO: 11081 - DNA, 2181 bp, Homo sapiens
gaagaccatcatccctggactacgttaggaggaagtggcaccgctccgaggtaggggaagaagggttataaagggaggcgtccaccacacatggtcttgaagaagcttttataaaaggcgaaggcatctttgccggacgttgttgcaaaggcgtagaaacaagcagaggaaaacatcccaaagggtaaccactagcgttcctgcttcttgcaacattcatcccgggcttccagctcagcccgccggggccaggtgatccggccgccacatcccctgcgactgaagcacctgctccgccatgaacttgccaagagctgagcgccttcgctccacaccgcagcgcagcctccgggactccgatggggaagacggtaaaatcgatgtcctgggagaggaggaagatgaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccgagttcagggcaccgccaaggtctgcggcggcctctgaagatgcccggcagccggcaaagcccccctcctcgtacatcgcgctcatcaccatggccatcctgcaaagcccgcacaagcgcctcacgctcagcggcatctgcgccttcattagtgaccgcttcccctactaccgccgcaagttccccgcctggcagaacagcatccgccacaacctctcgctgaacgactgcttcgtcaagatcccccgcgagccgggccgcccaggcaagggcaactactggagcctggaccccgcctcccaggacatgttcgacaatggcagctttctccggcgtaggaagcgtttccagcgccaccaaccgaccccgggagcccacctgccccaccccttccctctacctgctgcacacgccgccctgcacaacccccgcccaggccctctgcttggggcccctgccccgccgcagccagtcccgggggcctaccccaacaccggccccgggagacgcccttacgctctgctgcacccgcatcctcctcgctacctactgctctcggcccccgcctatgccggggcaccgaagaaagcagaaggcgcggacctggcgaccccggcacccttcccgtgctgcagccctcacttggtcctcagccttgggaggagggcaagggtctggcgtcgccaccgggaggcggatgcatctctttcagcattgagagtatcatgcaaggggtcaggggagcgggtacaggggctgcgcagagtttgtccccgaccgcgtggagctactgccccctgctccagcgaccgtcaagcctgtcggacaattttgcagcaacagcagcggcatcaggaggaggactgcgccaacggctgcgctcccaccaagggcgcggtgctgggcgggcacctgtcggccgcgtcggcgctgctgcggtatcaggcggtggcagagggctctgggctgacatcgctggccgcccctttgggcggagaggggacctcaccagtttttttagtatcgcccacgcccagttccctggccgagtccgcagggccctcctagagccaggtgggagtggggagcgacccgcagctgctcactccaccttgcgcggcccatactgggcgtgtgcatctgaatcccgctggagagcaaacacgaacttctgttccctgcaaaatggttagaaagaaacagctggattacgttcctctaaaaaccacctgaacgtaaccttcgcagggcgtcaagtcatcttttcttgccttcggttgtggcttctgtggctttcccgatttgcacatgtcctggggtactatgaacgtgagtggggtattttgttctggcattaaaagaaaaacaagcaagcaaacaaaaacacagcctccgatgccaaacatgttcccccttcttcacttccttggaactggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcact

SEQ ID NO: 11082 - DNA, 2068 bp, Homo sapiens
atctttgccggacgttgttgcaaaggagtagaaacaagcagaggaaaacatcccaaagggtaaccactagcgttcctgcttcttgcaacattcatcccaggcttccagctcagcccgccccgggccaggtgatcggccgccacatcccctgcgactgaagcacctgctccgccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatggccatcctgcaaagcccgcacaagcgcctcacgctcagcggcatctgcgccttcattagtggccgcttcccctactaccgccgcaagttccccgcctggcagaacagcatccgccacaacctctcgctgaacgactgcttcgtcaagatcccccgcgagccgggccacccaggcaagggcacctactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccgcccaggccctctgcttggggcccctgccctgccgcagccagtcccgggggcctaccccaacaccgcccccgggagacgcccttacgctctgctgcacccgcatcctcctcgctacctactgctctcggcccccgcctatgccggggcaccgaagaaagcagaaggcgcggacctggcgacccccggcacccttcccgtgctgcagccctcacttggtcctcagccttgggaggagggcaagggtctggcgtcgccaccgggaggcggatgcatctctttcagcattgagagtatcatgcaaggggtcaggggagcgggtacaggggctgcgcagagtttgtccccgaccgcgtggagctactgccccctgctccagcgaccgtcaagcctgtcggacaattttgcagcaacagcagcagcatcaggaggaggactgcgccaacggctgcgctcccaccaagggcgcggtgctgggcgggcacctgtcggccgcgtcggcgctgctgcggtatcaggcggtggcagagggctctaggctgacatcgctggctgcccctttgggcggagaggggacctcaccagtttttttagtatcgcccacgcccagttccctggccaagtccgcagggccctcctagagccaggtgggagtggggagcgatccgcagctgctcactccaccttgcgcggcccatactgggcgtgtgcatctgaatcctgctggagagcaaacacgaacttctgttccctgcaaaatggttagaaagaaacagctggattacgttcctctaaaaaccacctgaacgtaaccttcgcagggcgtcaagtcatcttttcttgccttcggctgtggcttctgtggctttccggatttgcacatttcctggggtactatgaacgtgagtggggtattttgttctggcattagaagaaaaacaagcaagcaaacaaaaacacagcctccgatgccaaacatgttcccccttcttcacttccttggaactggaagtgttattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactac

SEQ ID NO: 11083 - DNA, 3109 bp, Homo sapiens
ctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcgctccagccggggctgcaggtggcccggtggggcggggttgcgcttccccgagagcacatcgagggcggcggcggcccgagtgacccttcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccgcgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcttctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaagattagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatgaaagggaggaagagtgtcctatatcatatttattgttcaacaaaacactgctccacggcttcaattcagtttaaaaaagagaatttattgaacatttaacacatacataaaaggcagtaaagacaaatgagaagagggggggatattgaa

SEQ ID NO: 11084 - DNA, 2725 bp, Homo sapiens
acatacttttacggttacacattcctttacaaacaaccgtgtacatttcagcctcctgccccaccatttcttttctccaggcgggaaggctgcatgttgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggagggggctgggcttttctccggacgggtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccttcgctccacaccgcagcgcagcctccgggactccgatggggaagacggtaaaatcgatgtcctgggagaggaggaagatgaagacgaggtggaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccctactaccgccgcaagttccccgcctggcagaacagcatccgccacaacctctcgctgaacgactgcttcgttaagatcccccgcgagccgggccacccaggcaagggcaactactggagcctggaccccgcctcccaagacatgttcgacaatggcagctttctccggcgtaggaagcgtttcaagcgccaccaactgaccccgggagcccacctgccccaccccttccctctacctgctgcacacgccgccctgcacaacccccgcccaggccctctgcttggggcccctgccccgccgcagccagtcccgggggcctaccccaacaccgcccccgggagacgcccttacgctctgctgcacccgcatcctcttcgctacctactgctctcggcccccgtctatgccggggcaccgaagaaagcagaaggcgcggccctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagaatttgtccccgaccgcgtggagctactgccacctgctccagcgaccatcaagcctgttgcatccccagaccgctgcccctttgctgcaagtgtccgccgccgccgctgctcggacaattttgcagcaatagcagcagcatcaggaggaggactgcgccaacggctgcgctcccaccaagggcgcggtgctgggcgggcacctgtcggcctcgtcggccctgctgaggtatcaggcagtggcagagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgctgcaaaatggttagaaagaaacagctggattacgttcctctaaaaaccacctgaacgtaaccttcgcagggcgtcaagtcatcttttcttgccttcggttgtggcttctatggctgtcccgatttgcgcatttcctggggtactatgaacgtgagtggggtattttgttctggcattaaaagaaaaacaagcaagcaaacaaaaacacagcctccgatgccaaacatgttcccccttcttcacttccttggagctggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacactacatcgtttattttctattacatctcattcttccctttctaaatggaactttttaaaacctacgttattttccctcaaacaatttattttcacaattcatatttattatagatagcagaagtaatccattttaatatggcctttaaaaattccaaatatttgaggttgaaaatgtcctgg

SEQ ID NO: 11085 - DNA, 3451 bp, Homo sapiens
cctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgtgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagt

SEQ ID NO: 11086 - DNA, 1980 bp, Homo sapiens
gggaaggggtgagtctgggtctgggaaaaactgatccaaaggcagaaagggaggggcgaaatggaggagggtaccgtgaacagagtaagggggctgggagaggaaattagaggggaggcgctggccagcaggcaaggcctgagccctctcccccggcggtggttgggggggggccgtgtccatataaagcgggtcggcggcccctgcggtcccggagccgcgcgggcaggggctgccgcagccgatggcggggcgcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcacgctggccgccatctaccgcttcatcaccgaacgctttgccttctaccgcgacagcccgcgcaagtggcagaacagcatccgccacaatctcacgctcaacgactgcttcgtcaaggtgccccgcgagccgggcaacccgggcaagggcaactactggacgctggaccccgcggccgcagacatgttcgacaacggcagcttcctgcggcgccgcaagcgcttcaagcgcgccgagctgcccgcgcacgcggccgcggcgccagggccgccgctccccttcccctacgcgccctacgcgcccgcgcccggccccgcgctgctggtgccgccgccttctgccggaccgggcccctcgccgcccgcgcgtctgttcagcgtcgacagcctggtgaacctgcagccggagctagcggggctgggcgcccccgagccgccctgctgcgccgcgcccgacgccgcagccgcagccttcccgccctgcgctgccgccgcctccccgccactctactcgcaggtccccgaccgcctggtactgcccgcgacgcgccccggccccggcccgctgcccgctgagcccctcctggccttggccgggccggcagccgctctcggcccgctcagccctggggaggcctacctgaggcagccgggcttcgcgtcggggctggagcgctacctgtgagcctgcgccgcgcgggcaggcacctgtgcgacctgtgccccggacctgcggcgccgccctcgagcgccccatctctaccccccaccctggcttggagcacaccctgcgcctctcgtcgtggcctcctggactcaaactcctgctacatccttctccgtcccccatccctggggaggctcccaccatctcgccactggacagaagcgtcccctttgacctgccagcctctcatttcttctccctccacttgtgagcgcccccagctttgcggcgccccccaccccagcgctgtctgtgggtcccttgccccggagctgactcgcctccagtgagtccataccccaggtttcctggtgagttccaagcctttggaagccagatctgtgatcccaagccgcctcctccaccgactgtacttcatcaaccttctctcatgtttttccgacactcctgggtcagactcctgggttcatgacttacttgctagcgtcccttcattttcccacaagtttgccccccacctccacttacctgtctgccctcagcttcttcctgggagagagcccccctttcacgtagacacacctggctgccttcttcacgccctgaggacacttcttggagatttcagacaggcagcaccagggctcctgactgaaaggggagttggtgggcctttaggtctgccccatcccctggaaaacttaggacttattgggttattattatttttaattaaagctggtttaattaaaaagaaagaaacttttttctgg

SEQ ID NO: 11087 - DNA, 2187 bp, Homo sapiens
agcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcagtgggactgccccgttaccagcatcactctactccagtgtgtgacagaaaagatttcgtcctcaacttcaatgggatttcttctttccatccctcagctagcgggtcgtattatcaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagactcaggtgggaagatgtgccatgcgtaaggcatcaacgtgtatctgtgggatcttcgttgccttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataaca

SEQ ID NO: 11088 - DNA, 2584 bp, Homo sapiens
aggggtggttgctgcttttgctacatgacttgccagcgcccgagcctgcggtccaactgcgctgctgccggagcgctcagtgccgccgctgccgcccgcgccccccgcgccccgttcggcacccaccggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggacgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattc

SEQ ID NO: 11089 - DNA, 2754 bp, Homo sapiens
gagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgaaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggacgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattc

SEQ ID NO: 11090 - DNA, 1990 bp, Homo sapiens
gtcaggggcagctccggggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctatggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccgggatggagaattggttgagtagccaaggaaggtcagtgtgaaaagcttgctatggcaaatatagcgaaatctctccactgccttctgtccaccaacatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgt

SEQ ID NO: 11091 - DNA, 2009 bp, Homo sapiens
gggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccggcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctatggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccgggatggagaattggttgagtagccaaggaaggtcagtgtgaaaagcttgctatggcaaatatagcgaaatctctccactgccttctgtccaccaacatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaatcttgtaaagcccagtttcctgtgtgcatgtcatggaccagtgagctggagatggctgaatcttccaagagaaacaaggttggataagcgcttccttttttttagcccaggagaggtggatgtttgtctgagaaaacaatggcctcaagggaggggccttgggcccaccctcacagggggtctctgtgtgatctcttgggatttctccttgtttttgtgagtacctgggaagtgttgtttgttttcttattttctttttaattaaaaaacaaacaaa

SEQ ID NO: 11092 - DNA, 2630 bp, Homo sapiens
aggagaagcctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaattttt

SEQ ID NO: 11093 - DNA, 1158 bp, Homo sapiens
ccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagcgcggcgagtcctttgcacatgttggcaacacacgcatccgcatcggcctccctgcccacaaagcgccacaacggtga

SEQ ID NO: 11094 - DNA, 5265 bp, Homo sapiens
cggccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacctgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgtggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctcttgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgttttttttttttttttttgccgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaatggaa

SEQ ID NO: 11095 - DNA, 3450 bp, Homo sapiens
cgcggccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggcccggcgggctctcggggcgggcacgccgcgggcgcggggccgggggcggggggccgggggcggcgggtcccgccgggcgctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacagactgcgaccgcgattgcagggaggagcatctgaggtggtcacggggtttgcccagctcacaccaactgcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagt

SEQ ID NO: 11096 - DNA, 3189 bp, Homo sapiens
gctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctc

SEQ ID NO: 11097 - DNA, 2917 bp, Homo sapiens
atcagaacagagcgaggctcctggcgcactagggactccaggaggcagctccgccagagacgcgggtcgtgcttcgggaaaccggggggcggggggaggggaagagcgcagaaaagaaaacccaccaaggcggggactggcctgagcggggaggggcggcgaggccggagcccctctctgttgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttcttttaa

SEQ ID NO: 11098 - DNA, 2733 bp, Homo sapiens
tgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagcctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttctttt

SEQ ID NO: 11099 - DNA, 3475 bp, Homo sapiens
ggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtttttggggaacaggtggtgtttggttacatgagtaagttctttagtggcgatctgcgagattttggtacacccatcaccagcttgtttaattttatctttctttgtttatcagtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaca

SEQ ID NO: 11100 - DNA, 3315 bp, Homo sapiens
cggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggac

SEQ ID NO: 11101 - DNA, 3370 bp, Homo sapiens
gggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaca

SEQ ID NO: 11102 - DNA, 3436 bp, Homo sapiens
acggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctgggttcagaggtcaaagtcaagcccccagttctggagagtggtgctgggatgttctgctaccagcctcccttgcagcatatgtactgctcctcccagccccccttccaccagtactcgccaggtggtggcagctaccccataccctacctgggctcctcacactatcagtaccagcgaatggcaccccaggccagcaccgatgggcaccagcctctcttcccaaaacccatctattcctacagcatcctcatcttcatggcccttaagaacagtaaaactgggagccttcccgtcagcgagatctacaattttatgacggagcactttccttacttcaagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatgagctgtgcccagcttcgtcagctccagcgtttgcctggtctggaagtcctggccggccgcccacatcgggctcaccttaaaggtcaaggaaggaaaatactacctgtcccctatgccactaagccaacgtgtgtgtcagctggtagctgggggcgcagaggacatcacctggggtgctgcctctcacacatttctgccacgtggtggcccagctcctcacccagggcccccaaagagcaagcgtctgggcaagaggaaaatgccctgtccctagctcacactcatccacacttaagccctcgtgcacacacacaaattattcagatgtacacccacccacatatcttacagccagaggaaccagcactccatcactgagagcccgacttcgtttctggggcaactgagagctgagcgctttgcttaccaaaagctcagggccctgtgccaggccaaagatccccccagacccccattctgacatccacatgctctgcagtcctggccccctcgtcattttctttcccagaagcgccctgtatttattcccccatcttcatcccaacagcccagcaagaaggaggagacagagagctcctccctgggttgtctgtggacccccccaggagctgctaattggcagcacccactcagccattctctacccatccttagtacatgctctgtccagctttccccagggtgacatacagaaggggcaacatctacccgggcaccaaactgagcccaattccgaagcagtgtttggaaaagcccttgccctcggaaacttgaacatgtcctttttccccagtcccgggtgcaggaagggccccctccaggtcaccacaatctcactcctcctccagaaagaaaagttcacatagtttaggtcctggcttaactctacttatgatggttcaacttacactttttcaactttaagatggtgcaaaagcaatacacattcagtatgttcctcgacttaggatgcggttatgtccgataaacccattgtaaattgaaaccaccgaaagtcaaaaaccactttcgacttacgatgtttcccactcacgatgggtttctccggatgtagccccatcataagttgaggagcacctgttagttacttccaactgtctcaggcaacctgggcattcaggagaaaagcctggcacagggtgacagggaagcacccatgcaaagcacccccgctttgactgcttggcagacctagggtgcccgggaagcacaagggatacccttggccctgcggggtgtggcccaggtgcctgccatgagcctgaccccatcgagggggaacctcagcccaccctgggcctgggggtgacaagaacttccacaggttggccccaggcttataggaggcataagcagatcccgcgatggcttgtcattgtcccctgtcctggaacaataaagcaagtgccttgtggtctc

SEQ ID NO: 11103 - DNA, 7718 bp, Homo sapiens
aggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagcccttaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtacaaagagaaatctctaaaagaatatgatcttccatccaagtggagggaaactttaaaacaaaaacacccagtactgtggctcaggatatgatgcgtgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttccaaactagcatatgtatccattagtctgacagatcgcctgaacaccattaagaggtgtggcgtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattg

SEQ ID NO: 11104 - DNA, 7832 bp, Homo sapiens
ccgggagacggcgcgacccggcggcggggccacccgcgagtccagcgtcgccgcagccccccaatgcggccgcgagaagcagcgggggggcaggcgatcgaaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagcccttaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtacaaagagaaatctctaaaagaatatgatcttccatccaagtggagggaaactttaaaacaaaaacacccagtactgtggctcaggatatgatgcgtgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttccaaactagcatatgtatccattagtctgacagatcgcctgaacaccattaagaggtgtggcgtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaacacca

SEQ ID NO: 11105 - DNA, 337 bp, Homo sapiens
gtagcttgcaggtttctgatatcgcatcagtggacaggcggcatgcactatattaacagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccat

SEQ ID NO: 11106 - DNA, 505 bp, Homo sapiens
ggcattccccttctgcacgatggcaaaatctgggcaaagttgaaagttgcaagattccagtcaaacaattgtccttgcttgggtaaatatcctcaaatgaaaaaaaatcagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgaca

SEQ ID NO: 11107 - DNA, 1595 bp, Homo sapiens
gcgatctgctgcagctcggccgggagacggcgcgacccggcggcggggccacccgcgagtccagcgtcgccgcagccccccaatgcggccgcgagaagcagcgggggggcaggcgatcgaaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtc

SEQ ID NO: 11108 - DNA, 851 bp, Homo sapiens
agctcggccgggagacggcgcgacccggcggcggggccacccgcgagtccagcgtcgccgcagccccccaatgcggccgcgagaagcagcgggggggcaggcgatcgaagcagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttat

SEQ ID NO: 11109 - DNA, 2692 bp, Homo sapiens
gcgggaggacgcgcggcgcgcccggcggacgccgcaggtcccatgccgcgccgcgacccccgcgcccctgccgcccgcgcccgcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaa

SEQ ID NO: 11110 - DNA, 3226 bp, Homo sapiens
aaattgcggaacgcgaggggcgagcgcgagggagcccccctccggaacccctgcccacccccggagcgccggcagcggcggccccgcgaggatcggctccaggagatgatagaaagtgacacctcatccataatgtcaggaattattcgaaactcagggcaaaatcaccacccctctccacaggaatacaggcttctagccaccaccagcgatgatgaccttcccggggacctgcagtcgctgtcgtggctcacggcggtggatgtgcctcggctgcagcagatggcaagtggccgcgtggacctgggtggcccctgcgtgccacatccacacccaggtgccttggctggggtggccgacctgcatgtgggagccactccaagtccccttctccatggcccagcaggcatggccccccgaggcatgccaggtctgggccccataactggccacagagacagccagatgagccagttccccgtggggggccagccctcatctggcctgcaggacccgccgcatctgtactcacctgccacccaaccacagttcccgctccccccgggtgcccagcagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtactccactccggacagtgtggctgcatcgggcaccagctcctcctcccagtacctgggtgcacaggggaacaagcctatagccctgctttgagctgtcagcctcacctgccctggaaccccggcacccggcttgggcagagaactgactagaacagggtgttcccagaaggcaggtccctcattgtccccgaagcctctcctggacctgtggcgaagttgccggctggacagggaagcggttcccctcagcagcccctctccttctcgtgcctccccctggagcttccggagcagtttctgggggctcttccaagtcagaagaatggaggaaggtggacaagcaacccagcatcccccgaccccttgacactcctccgaggcctgagccgcaatgcctgcccgtgttgagtgagacttctccatcctggatcctggctgcgtgacctcagtgacctgcaccccattttgggacaccttggtgcattaaggaaacaccctggggtgaaagcccttgaattcatcctcatgggaaatggctgagtggatcaaacctcagccgcagcctccgggggacaggcccagggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgattcacatctcttcttgcatgtacctaagaggggcggtgccattgtttgggggcttggggggctttcaaaggggaaaatgcgatgggagagggaggaactggaggggggtgcttttgtactgggatttaagacacccctgatggaatgaaagccaactgaaccacgtaaagctcgaaccacgtggcaagtggtggacaaaacttcaacgcatgatatttattggcacttcctcacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatggc

SEQ ID NO: 11111 - DNA, 3350 bp, Homo sapiens
aaattgcggaacgcgaggggcgagcgcgagggagcccccctccggaacccctgcccacccccggagcgccggcagcggcggccccgcgaggatcggctccaggagatgatagaaagtgacacctcatccataatgtcaggaattattcgaaactcagggcaaaatcaccacccctctccacaggaatacaggcttctagccaccaccagcgatgatgaccttcccggggacctgcagtcgctgtcgtggctcacggcggtggatgtgcctcggctgcagcagatggcaagtggccgcgtggacctgggtggcccctgcgtgccacatccacacccaggtgccttggctggggtggccgacctgcatgtgggagccactccaagtccccttctccatggcccagcaggcatggccccccgaggcatgccaggtctgggccccataactggccacagagacagcatgagccagttccccgtggggggccagccctcatctggcctgcaggacccgccgcatctgtactcacctgccacccaaccacagttcccgctccccccgggtgcccagcagtgccctcctgtgggcctctatggccccccatttggggtgcggcccccctacccccagccccacgtggctgtgcattcatctcaagaactgcaccccaaacactaccccaagcccatctactcgtacagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtactccactccggacagtgtggctgcatcgggcaccagctcctcctcccagtacctgggtgcacaggggaacaagcctatagccctgctttgagctgtcagcctcacctgccctggaaccccggcacccggcttgggcagagaactgactagaacagggtgttcccagaaggcaggtccctcattgtccccgaagcctctcctggacctgtggcgaagttgccggctggacagggaagcggttcccctcagcagcccctctccttctcgtgcctccccctggagcttccggagcagtttctgggggctcttccaagtcagaagaatggaggaaggtggacaagcaacccagcatcccccgaccccttgacactcctccgaggcctgagccgcaatgcctgcccgtgttgagtgagacttctccatcctggatcctggctgcgtgacctcagtgacctgcaccccattttgggacaccttggtgcattaaggaaacaccctggggtgaaagcccttgaattcatcctcatgggaaatggctgagtggatcaaacctcagccgcagcctccgggggacaggcccagggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgattcacatctcttcttgcatgtacctaagaggggcggtgccattgtttgggggcttggggggctttcaaaggggaaaatgcgatgggagagggaggaactggaggggggtgcttttgtactgggatttaagacacccctgatggaatgaaagccaactgaaccacgtaaagctcgaaccacgtggcaagtggtggacaaaacttcaacgcatgatatttattggcacttcctcacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatgg

SEQ ID NO: 11112 - DNA, 2958 bp, Homo sapiens
aaattgcggaacgcgaggggcgagcgcgagggagcccccctccggaacccctgcccacccccggagcgccggcagcggcggccccgcgaggatcggctccaggagatgatagaaagtgacacctcatccataatgtcaggaattattcgaaactcagggcaaaatcaccacccctctccacaggaatacagggtcaagcagggcaggcttcctggcagaggcggcattgggctgtcagcctgagaccctttcatgcctggcctgccctgtcctgccctgccctgccctgccccacctcctgcccccagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtactccactccggacagtgtggctgcatcgggcaccagctcctcctcccagtacctgggtgcacaggggaacaagcctatagccctgctttgagctgtcagcctcacctgccctggaaccccggcacccggcttgggcagagaactgactagaacagggtgttcccagaaggcaggtccctcattgtccccgaagcctctcctggacctgtggcgaagttgccggctggacagggaagcggttcccctcagcagcccctctccttctcgtgcctccccctggagcttccggagcagtttctgggggctcttccaagtcagaagaatggaggaaggtggacaagcaacccagcatcccccgaccccttgacactcctccgaggcctgagccgcaatgcctgcccgtgttgagtgagacttctccatcctggatcctggctgcgtgacctcagtgacctgcaccccattttgggacaccttggtgcattaaggaaacaccctggggtgaaagcccttgaattcatcctcatgggaaatggctgagtggatcaaacctcagccgcagcctccgggggacaggcccagggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgattcacatctcttcttgcatgtacctaagaggggcggtgccattgtttgggggcttggggggctttcaaaggggaaaatgcgatgggagagggaggaactggaggggggtgcttttgtactgggatttaagacacccctgatggaatgaaagccaactgaaccacgtaaagctcgaaccacgtggcaagtggtggacaaaacttcaacgcatgatatttattggcacttcctcacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatggc

SEQ ID NO: 11113 - DNA, 2398 bp, Homo sapiens
ggcgggaccatggctgcgaagctgcgagcgcatcaggtggacgtggacccggacttcgcgccgcagagccggccgcgctcgtgtacctggcccctgccgcagcctgacttggccggcgacgaggacggagcgctgggcgcaggggtggccgagggcgccgaggactgcgggccggagcgccgggctacggccccggcgatggccccagcgccgcccctgggcgcggaggtcggaccgctgcggaaagcgaagagctctcggcggaacgcgtgggggaacctgtcctacgccgacctcatcaccaaagccatcgagagcgccccggacaagcggctcacgctctcgcagatctacgactggatggtccgttacgtgccctacttcaaggataaaggcgacagcaacagctcggccggctggaagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccggggccccgccccccaaccagagctgggtgccgggctgagggccgcctcccgcctccgggcgccccgtcccgtccccagggggcctctgtcttcccatcctgattcccgggtccctgcccccgactctagctccccaggaggcggccccagcccagctagggacccctctcggaggccggccgccggggaaggggagggaggggccggggcaccccactgctcctgcccacactcctgagatccacccccttctcctgggcaggaagcctgggagaggaggctgaattccaggctggctgggagtagggaggagcggggtgggccgcctggtgtggacggtggtcggggaagccaactaggagatgggccagggagcgtttacaaatcttcagtttcatttgcggaggcctagccgtgaccccgcgcccaccccaaacacggatctgattcccacttgacacactttcccactggtcttagtctcacccacccgaagccagcaaccctctgcggaaaactcacacctacctatatccatccaccctgagcagccctccacccccaaatcgccctccgacgaccgccacccccacagttcagtctccccctcccatccctgccggccctcgcttctcccctcccccgtcggagtcagtccctctcttcaaccgcccccaccccctagtactggtctcagcttctgcagcgggcctcagccccgtccacccccaaccccgacgcccctttctccgcgccagttctggcccttctcccatatttataagtgtccggccgggacgggcggtgggcgcggcgtccccggcgcgtatcgtaggcagtgtaccgtggccgtgccgtcagagtgtgcgtgtgcgtgtgtgccgtgtcgaggctgtgtagagtgcattgtacagcatattttcatgaataaaattgttttaaatatt

SEQ ID NO: 11114 - DNA, 7114 bp, Homo sapiens
ggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggtagtaaaagttgccacagcctaa

SEQ ID NO: 11115 - DNA, 6220 bp, Homo sapiens
ggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgta

SEQ ID NO: 11116 - DNA, 2032 bp, Homo sapiens
ggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaaaaaaaaaaaagagagacaaactctaggaacaatgccgattcattccacgcagcag

SEQ ID NO: 11117 - DNA, 5132 bp, Homo sapiens
atgatgacacctcaagttatcactccccagcaaatgcagcagatcctccagcaacaagtgctgagccctcagcagctccaggttctcctccagcagcagcaggccctcatgcttcaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgta

SEQ ID NO: 11118 - DNA, 4967 bp, Homo sapiens
atcacagcttggtgctggggctcagcatggccaggtggctaaccagggcttggtgtcaactacatttgggatgatgacacttggaggacacagagccactgtgcagcaggagtcgccactgctaacagccagagtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaa

SEQ ID NO: 11119 - DNA, 1996 bp, Homo sapiens
agtctagagacttagaagcatttattaacagtgaggctgctgaaggtttttaataacaaaattacaaatactctatctaattggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattgg

SEQ ID NO: 11120 - DNA, 795 bp, Homo sapiens
gtgcagtccgcctgcacgccgaggccgccggaccccacgcccggcccgcgcgggcgccccgagcccggctccgcgcgcctggcggctacatggagagtgtcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaa

SEQ ID NO: 11121 - DNA, 2250 bp, Homo sapiens
tgcaactttgaaaattacctgcaagctccaactgatctttcaactttgaaagtgaagaattacttgaggaattcttgtggtttctttgtcatttagtgagagcccagccagctactgtggaggcaaacctccctgaggttgcctacaaagggcaatgttccagtgtgttttctcttcgagtgtgcttcagccgcacagtacttcctgtttattcaaacatcttttttaccactcggcaacccccgcttcgcagaaacagccagaacccatctacagcaagaagacggaaatccaaaggcagacagtacgggctcccttcgccaaactcttcattttctctgcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaa

SEQ ID NO: 11122 - DNA, 530 bp, Homo sapiens
gcttattgagagtagcttttgttgttgctattgttgtataaataagaaaggaatttaaagaattatttcttagcaaacgtgtggcagatgctttcttcggcagctgtcgttctagaggggaagtcgcctggttcagcgacgaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggtatg

SEQ ID NO: 11123 - DNA, 2400 bp, Homo sapiens
agacaataagaaacaaacggtacaactccacaaaaggcttcccggaaaataagtgtcaaataaatcctacggaactctcgcttctgccactgagctctgtatatgcaaacctgtttttatgccatcgcttccccaggctgagctgcgtttgtttggaaatgtaagccactgccttttctttttttcttttttccttttttttttttcccccctcacttcatctgagggctctggattaattccttgagacatatctttgcatacatatctcatgagttatgtttcctggagccttttactaggaacattaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 11124 - DNA, 843 bp, Homo sapiens
gctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaa

SEQ ID NO: 11125 - DNA, 1016 bp, Homo sapiens
atattaaaatccagtaagtttcttgatcttgaggattattcctggagtactcttcgctccctggtgggcaggctttggccatgcaaggtgcgctaggtggcctggatcaaacaaataatagaagtctgttgaagctttgtcctgacctatcctggaagtagaagaatactctggagaaaggagcattgtaagcacaaagaataagattcctcaatcctgagagagagaattaaagtctaactctccaaatgtctactctaatgtgatgctgggattgaattttcctaggactccgtttcaaggttaattcgaaagtcttgtggaagatctggaagaaacaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttct

SEQ ID NO: 11126 - DNA, 2638 bp, Homo sapiens
ctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggca

SEQ ID NO: 11127 - DNA, 1412 bp, Homo sapiens
aggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctgtaagtgcatattgctttataaacagtaaatagctctaccaatgtaacagactaagaaaatgaacaatttagtgacagttagaaaacaatgagtgtgatgaaaaatacggcaataaaatgaaagtaaaatgtaa

SEQ ID NO: 11128 - DNA, 1472 bp, Homo sapiens
atgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggaattgcttccagaaacaaaattatgtatctgtggccactcttctggtgatgggcatcctcacaacacatttgcagtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctgtaagtgcatattgctttataaacagtaaatagctctaccaatgtaacagactaagaaaatgaacaatttagtgacagttagaaaacaatgagtgtgatgaaaaatacggcaataaaatgaaagtaaaatgtaa

SEQ ID NO: 11129 - DNA, 2285 bp, Homo sapiens
ttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcagccatgagacagacttgtggttcttcaacagctgtgcagagcagagacgtaaatttaaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaaggg

SEQ ID NO: 11130 - DNA, 1593 bp, Homo sapiens
atgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctgctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatga

SEQ ID NO: 11131 - DNA, 2664 bp, Homo sapiens
tgcatctgctgtgtacagacttggctttgtactcttttcctgggggagagaaagtctttcttctctgctagttgattcctgtttttgtgaaacagctaagaaaacatctgtggcaggcagaaaaattgacaaaggattgacaaacaccattagctgaaaattttccatttcattgcaactatgcattgtttactttactgtaaatatcttaatacatcatcctctgaatatgctggcagagaagctggagaactgtgatttcaattaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaa

SEQ ID NO: 11132 - DNA, 8300 bp, Homo sapiens
gccgccgcgggtgccacctcccgggacgctgcccacggcgtccccggtcgcgatcaaacaaataatagaagtctgttgaagctttgtcctgacctatcctggaagtagaagaatactctggagaaaggagcattgtaagcacaaagaataagattcctcaatcctgagagagagaattaaagtctaactctccaaattttcaacaggagttttgagtaaagaaaatggagaagtttgtgggagagaaaggtctactctaatgtgatgctgggattgaattttcctaggactccgtttcaaggttaattcgaaagtcttgtggaagatctggaagaaacagccagtactcatatatatagaaagaggagttggatgtttgtcaataaactcatctggctttaaataaatcaaaacaaaaagaataatttgctactagtcttccaacatgtttgaagaacagcctgctgtttggggaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcagccatgagacagacttgtggttcttcaacagctgtgcagagcagagacgtaaatttaaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggattttttggattctggattggaaaatttcagagctgccttggaaaaaaatcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctaatatttgcaaagtcacatacagatgcatatggatgtttctgcgtttctcaaactatgcagaggtgctcttgtacatcccagagaagcttacaccagtggctttgtaaatgtattaaatgcagcatttaggagcattatctcagctttcatttatctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatgtaagtgtggttaacagactctctaaagggaagaatctatattaatatgcttcttaaatttagaatttttccgaagtttttactgttgtataagttgaaaatacaaatttaagtggagttaaattataccacgttcataatatgacaaagtttatcaaaatcggttttaatacattttttagatgatctcaaatgccatatcattattgttccagcagtcctctacagattcttagtactactaatgttctcttgggcataaagcagtgtctaagatgaatctacatcttatgggtcattatcacaggttggtttgtatggtgcaataagaatattcatgatggaataagttgttataatttttactactgttacaggtctctaaaccatttatgaactgtagtcaagatattgcccgtttttataaaccgtaaaatgcaaagtttaactgttacccacagtttacatagaagctagtaaagtgtaactttttgcctgtcttataaatcagtgtaattatatattcaactttaattactggtgcgtctgtattggcaaggtttataagttatattttatgcaagactacgattcctattaatatttagcagctaactatatcattaattactctaaaatctttcccctaccatctttttaatggagctgagagagtagaagtattaaaaattgatgtattgtggatttcagaaatgtgtatgacactttaaaaaatgcctggcttttttcaatagtgtcaagcatattagtgtcttgtttactaaaatgtattgaccgtggtagaactcagaattcagaggaaaaaaatttgaatctgaataatgaagtgtgtacaccatttagctgtcaggatgagttgtaactcatgtctatacttcctagaattaaacgtcacatacttctaattacaagttattgaggtaagattagtcctttctcttatttttatattgtcttcctttatttttccattcaatatctagtaaaaggtctgaaagagaaatatactctttatatgtacccattttcacttgacctttcacagggtattatttttgttgtctttttaaacattttattctgtttgacatattaatgtctttaagagcatatgtctaattgctttatagcacttttactctatcacctttgcaaaaaaacacactgtgaacattaatgtgttttatcaggttccgaaccattacttcttcaaaatggaaaaatttgtcttttggaagtgtctttagatgtattaaataatacaaaagaagtaataaaactcaaagtagaaagaacatgaatatatgctcttgagagtagcagtattctaaaacaaggaaagtgagcaatcagacaaaagtttttatatccccgctttatcctatcagccatgcagtgggtagcttgcggccttttactttcagcagttctcctgagtatgctaaatagtttattaaacattatatttcagaacctgaaataataattgggctaaattgtagcattgttagatgggtattggttttcgtttggcaattgctacttcagatttttcattttattattaaagtttatgaaatatttcagagaaatattagtatgtattagataacacctaaaaattatacatataatgtccagtatattgctgctatgggtttataaagttaaaatgttcatagttaatatataacacattttatgcttatatgaattagtgcatttgaaaaatacttatgtttattttccatagataaaaggaaagcttgttgaaaatagatttcagaaaaaataaaaattaaaaggggtgtaaattgtccctttttctaagttacatcaattataatcaaaattttaattatcttgcagaatattgagtcaatattcattcttaaatctgtttctgctgctgtcattaggtttttgcataatagatgtcaaatatttatgaaatatttcagtattctctatcttcacctttataaagttctaagatgcttgtacttaaaccatgttatgtattttattaggcaaaggaagaaatattgatataattctctcagtcaaaatttggttgtatataattgagtgcatttcaaaatactttggaaattaaacagaagtgaaataatttttataagacatttacacagcatacttatatctcctaaaatgaagtcatgttacttgttgttttagaggggggtagttgtgctgatgcaattgtaaacaagaggaaatagggcctagtggtatcagaacataggttgtaatgccagactgtcagggttccaattccagattcaatagttaatagccaagtgggattgagcacgttacttaatatttctttcctcagctttctcagctgaaaatgaggtaagtaataatataatgcttcttatttcataagattcttgcaaagaaatgagtgcctggaacataataattgctccttgtgtctctcatagtgctgtgtaaataggtactgatttatattacttcctgtaatacctcactgttactaaaaatgagtctataaacaatatgaaaatatttttgtattttgcattttaaggcactctgtaagtttgtggttagtcattgacaatccattttcttctccttctttcttctcttataattcataaagtaagcagatccataaaactgaaacaacatgaggccaggcatggtggcttatgccagtaatcccagcattttgggaggggagggcaggaggattgcttgaggccaggagttcaagaccagcctggacaacatagtgagaccctgtatctacaaaaataattttaaaaattagttgggtgtggtgtgtgcctgtatacagtcctagctactcaggaggctcaggcaggaggaaagcttgagcctagggatttcgaggttacagtaagctatgatcatggcatggaactccagcctgcaccacagagtgagactctatctgtctctaaaaataaaaagtgaaacaatatgacacaaggacttattataggtagcacattacctatatttaggtatctgaagttacctagttatctgaagttttaggcaatgaacaactcaaatagaacaacaccaacccagaatcagggacatatcatatatgtcttgaaaacattgagtattagttttgaaaggaatttagaatacataagggaatacagaatttagaatataggaagtgggaccagactgctgagtgacttaaatatcaagctatggtgtttgtttcagtcagtatacagcttgttactgttatcagcttgactttgacacgatcagagctatgcattagaaacagtaatctaaaagtgtactgaatgaaccatgacttaatgaaactcatgtataggagaatattctgaaattgggagagactggaagcagaaaattaattcttgcagtatgtaatatctaacataaatacaagactaggagtggagagcaaagaatccgtataagaagtgctgtgaaaagaaatactggaacaagacaaccaactgaatgctagggacaaagatgaaaattgggaaaattcatagccactttaaaagtctgcaaagagaaatagaggacacaagaagcaggttcaaaagggaagatgaagaattcagcattttacttggggaatctaagaacctaaatatcattagattcaggagaaaacactgatgatttttttgattagtcttttaattcaactccattatagtaaaattctacgtggtagaatatgaatatatacctgaggttgatagagaagatgttttttgaagcattagaagagtgaaatagatatggtctggtgcttcttataaattgtggagaacaagagatgccaaattatcatttatattccatactccatattttaacccttttcttccactccagttttcgctttattcagtgtcctgaataaaggcctcttccaaattaatgcatttatttcgctcacactatttgaatttctgccctttcccttttctggttcccctctactctcttacctaaattctacctttccttacaggactagtcctatttttttccaagagggtttcccaaggaattttactatcaggaccatgcactctgctccacacttctaaagagcttgcttcttataccactattttggactaatactttgtgtacatgtgtgagtgtgtgtgcacacacacatgcacgtgtgtttatgcatacatctgtgttcattttgcagatatccctaccttaatgacaagtcccttaaagacagattatgttttagacaaattatagtataagaaacccctagcacattctactatgtcaagtaagcattcagtaaaagtatgatactgattatgaagaatcaaattggagattacagttaattagaaatggtttgacttcacaaagtcatacttacaggagtataaaatccagggttctcctagaatcttgaagaaggagaacaaaagagattttaggaagaacagatgagtaaatataatgttcatttttatgtgggagctaggaaaattttctaaatattggtagactatactttttaagttttatttttagttttaattatttaattaatatgtattttataaccattccaatttacgtgagtaaaaagtggctttccactttgagtagaatgaggccccttcacctcattcatgattatcatctcaaccttgttaaattttatttacattgttgaaagattgaaaacaattatcaaaatttaggcaatataaatcagatgaatgtttaaggggatttcagcaaaaagtaggaaaggttaaagccaggcgacattgtatagattctacataataattttttgaaacttctttgactgttttgactcaactacttattgattcaaagcaagtacttcacttttaaaacatttttattttctattgctgttcaaagagtcctagaaacatccatggtatgaataaaggaaaacgatactttaagtgtccgagctgagtatcattacaatttataatattgttcccttatgcacctgaatgccaatattccctttttcagagttatatagaatatgaattaaaaatgactagcttcctattttatatagacatttacctctagaaatgtttaaaaggttaggattgatgctgtctttaagcagaaataatttgaacttactgtcttctctcatgtgttggacttaagtgaatgacaagagaagaaaacatgtagactagacttggaagatgaacgcatactgatacaatcaatccatttcctgtctacttcccaacctaaggcaagaagtggaatttaatgatgtacccaccatgtttagttctactcagttgtttctttttgtattaagtaattgtttctcctcattctcaataagttggttcagatttgctgttcttcctcgtataaaatgttaaatgagattcccatttttatattttcaaatgttgtgtctagagatcaaaataaatattcttccct

SEQ ID NO: 11133 - DNA, 6415 bp, Homo sapiens
cttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggattttttggattctggattggaaaatttcagagctgccttggaaaaaaatcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctgcaaaaaaaaaaaaagaaaaaaaaaaaaagaaaaacattagaacaattatggcagattgcatgaaacgtgagaacgtcacagtaactgctacttttcattatgtttgtctttgggtcatgatcaacgaaccggaagtttacaatatggtattaaaagaaagatgggtatggtgaaagatggttttcagtcatctaggatcctactgtaaggattatctgaaaggaaaaatgggtctttcaggtgcatgttcaaaaggctttgagggactggaagtaactgcgagagttgtaccatcagaagggtggcctaagactacaatgctaaagtatgcatacctcagttagaaaacttttgaaaggaagtctcagccacagaatgcatatacctgtagagttttgcatgggttttatatgaatacaattttaaaaaatagctgcttgcacattataccagaaaaacctccaaaactgcaattgctttgaaaatagattttaggttttttggagtttcctgaaatgcttggtctgtattttgataattgtgcatattatgtaaaaatgttggtggacccataaatgaccagactttttctaagaaaaatgttgctttaatgcatttcatgaatttttactcttatatcattgcttgctagtaatagcaaatctgcttttctgcatctgctttgcgtagctattgtaaggctttgaactaatgtatgtatttattgcttgaacttctgtgcataccttataaagcataatgtctgacaatttaaatggctcatgtattcttgcttctatcataagctgattatggggactatgatcttttgtatacagcaaattttaaactgtagcacaaacatctgtttatgtattggtggaatatacctgttttatttatcttttttgaggtaaactaatttttgatacttttcattactgtgtactatgttcatactttgaattctctgacgttagaagtcatggttgagaattgtaacagctgttattcgttctgtattcatggctttcactgctgaataaaataaaggaccaaacctaggatttgaaagaaaactgtctacctctaacaccagggagttatcagattttattttacatagttttagtctacaaagacacaattgcttaaacctagtgggcttaaggcttatattctatgtggttggattcgtggcacagttgtactatttgaaaatcaattaaaattttatgtgaatgttacaagtatttggtagaattaccactaactgggttttctttagataactcagatatggagaaaatgtcatcagcattctgtgtctacagctgcttaacttcataagaatgcatttctttgtgattagggaatcgaagaatagtcagctaggaatagagctacagaagtacacttacataaaccatcctggactttaatgtccctgggcagattcagtcgcaaaatccaatatgatattttgtaaagttttcaagttggacatttacatttttgagaattttgagacttcatcttacacatgccagtattaacacacatttggacaatagctttattaagtctataaagctattgaaaggaacatggcttacccttgttatttcactagttcaggttgcaacgaaaggtttttttgtccatgaacacttggcatatcttacttagcaaaaaagaaggatgtacattttactatagaattaatgtatgaacagtgtgtcactgctgttggatgtaaaaatgtatatgaaaccatttcattcacttgattacatttctgaagtataaataaaaaaatctaattctttttgacccattt

SEQ ID NO: 11134 - DNA, 6443 bp, Homo sapiens
cttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggaattgcttccagaaacaaaattatgtatctgtggccactcttctggtgatgggcatcctcacaacacatttgcagtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctgcaaaaaaaaaaaaagaaaaaaaaaaaaagaaaaacattagaacaattatggcagattgcatgaaacgtgagaacgtcacagtaactgctacttttcattatgtttgtctttgggtcatgatcaacgaaccggaagtttacaatatggtattaaaagaaagatgggtatggtgaaagatggttttcagtcatctaggatcctactgtaaggattatctgaaaggaaaaatgggtctttcaggtgcatgttcaaaaggctttgagggactggaagtaactgcgagagttgtaccatcagaagggtggcctaagactacaatgctaaagtatgcatacctcagttagaaaacttttgaaaggaagtctcagccacagaatgcatatacctgtagagttttgcatgggttttatatgaatacaattttaaaaaatagctgcttgcacattataccagaaaaacctccaaaactgcaattgctttgaaaatagattttaggttttttggagtttcctgaaatgcttggtctgtattttgataattgtgcatattatgtaaaaatgttggtggacccataaatgaccagactttttctaagaaaaatgttgctttaatgcatttcatgaatttttactcttatatcattgcttgctagtaatagcaaatctgcttttctgcatctgctttgcgtagctattgtaaggctttgaactaatgtatgtatttattgcttgaacttctgtgcataccttataaagcataatgtctgacaatttaaatggctcatgtattcttgcttctatcataagctgattatggggactatgatcttttgtatacagcaaattttaaactgtagcacaaacatctgtttatgtattggtggaatatacctgttttatttatcttttttgaggtaaactaatttttgatacttttcattactgtgtactatgttcatactttgaattctctgacgttagaagtcatggttgagaattgtaacagctgttattcgttctgtattcatggctttcactgctgaataaaataaaggaccaaacctaggatttgaaagaaaactgtctacctctaacaccagggagttatcagattttattttacatagttttagtctacaaagacacaattgcttaaacctagtgggcttaaggcttatattctatgtggttggattcgtggcacagttgtactatttgaaaatcaattaaaattttatgtgaatgttacaagtatttggtagaattaccactaactgggttttctttagataactcagatatggagaaaatgtcatcagcattctgtgtctacagctgcttaacttcataagaatgcatttctttgtgattagggaatcgaagaatagtcagctaggaatagagctacagaagtacacttacataaaccatcctggactttaatgtccctgggcagattcagtcgcaaaatccaatatgatattttgtaaagttttcaagttggacatttacatttttgagaattttgagacttcatcttacacatgccagtattaacacacatttggacaatagctttattaagtctataaagctattgaaaggaacatggcttacccttgttatttcactagttcaggttgcaacgaaaggtttttttgtccatgaacacttggcatatcttacttagcaaaaaagaaggatgtacattttactatagaattaatgtatgaacagtgtgtcactgctgttggatgtaaaaatgtatatgaaaccatttcattcacttgattacatttctgaagtataaataaaaaaatctaattctttttgacccatttataa

SEQ ID NO: 11135 - DNA, 2274 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctcccc

SEQ ID NO: 11136 - DNA, 2382 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccaca

SEQ ID NO: 11137 - DNA, 1215 bp, Homo sapiens
atgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcaggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctga

SEQ ID NO: 11138 - DNA, 1213 bp, Homo sapiens
cctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctga

SEQ ID NO: 11139 - DNA, 3745 bp, Homo sapiens
cgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 11140 - DNA, 3300 bp, Homo sapiens
gcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaa

SEQ ID NO: 11141 - DNA, 5948 bp, Homo sapiens
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatg

SEQ ID NO: 11142 - DNA, 5910 bp, Homo sapiens
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatga

SEQ ID NO: 11143 - DNA, 3341 bp, Homo sapiens
ggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaacc

SEQ ID NO: 11144 - DNA, 2318 bp, Homo sapiens
ctcaacgtcgaaccgaaggcgacacccacccaactcctccctctccgccccatagtccacccaacacttgcagcccctccagagaaaaagcccagcggaagaggactccggaaaagtgactatctcggaagaccagggtagagctcccgggagaaaaaggcgaagatccccggccccggatcgccatccccttccctggcaccagcttctctaggctgcgcgaaggaagagggtacgacgccggggagggactgggtgcgcgggcatgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaacagcccggccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgccgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctcagtccgccgccctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtg

SEQ ID NO: 11145 - DNA, 1905 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatca

SEQ ID NO: 11146 - DNA, 1860 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggtgagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatc

SEQ ID NO: 11147 - DNA, 1954 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggtgagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacggtgcgggaggcctctccgggctctgtggcccctccctcgcccatccccagagggcagagctgtgacctcgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatc

SEQ ID NO: 11148 - DNA, 1834 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggagggtaggtgggcaggcagcggggcatcgcctgggaatggaggcgctggcagggacagaaggcccctagtcccatgtgacctccagtaaagttttggcaccaaa

SEQ ID NO: 11149 - DNA, 1878 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggagggtaggtgggcaggcagcggggcatcgcctgggaatggaggcgctggcagggacagaaggcccctagtcccatgtgacctccagtaaagttttggcaccaaa

SEQ ID NO: 11150 - DNA, 1955 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacggtgcgggaggcctctccgggctctgtggcccctccctcgcccatccccagagggcagagctgtgacctcgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatca

SEQ ID NO: 11151 - DNA, 1977 bp, Homo sapiens
attttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagtctcccaagcagcaaaaggaacccctctcccatcgcttcaacgagttcatgacctccaaacccaaaatccactgcttcaggagcctaaagcgtgggcatagtcttctcaaaggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccat

SEQ ID NO: 11152 - DNA, 5206 bp, Homo sapiens
atcagatggacagatgaactttgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggccttctttcaagcagggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 11153 - DNA, 5393 bp, Homo sapiens
gctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggcatagtcttctcaaaggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 11154 - DNA, 5398 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggcatagcctcactctgcagggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 11155 - DNA, 990 bp, Homo sapiens
tgtcatatgttaaagtcttatggttaattttatttattttatcttgttctcttgctggttattggcagactcagtctttctgttttcacaaagaactcatgaagaggacgatagggaaacccacgtatgcctttgaggctagggactatgttctttctctcaagctgggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctg

SEQ ID NO: 11156 - DNA, 5425 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggctttctctcaagctgggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 11157 - DNA, 2271 bp, Homo sapiens
aactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggcatagtcttctcaaaggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccatgactgttacaggcagttcctcaagagactggctggcaagcaccataatgcacgttctcctgtagtctcacgtggacttcagggtctgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggc

SEQ ID NO: 11158 - DNA, 3990 bp, Homo sapiens
cgggattcccattgggccctgtgagtggctagcggcggccccgcctccggcagtggttacctcctggcgcgcactcggggactaatcttggctccacccccttcctcggccccgcctccgtctggccccgcccctccagccgcgtccggtccggccgggcccgaaccgcggagctacagtgtgctttgagtagaagctgcactggggccgggactcggaggcgcgctgcgtgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgagctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 11159 - DNA, 4942 bp, Homo sapiens
gctgcggctgcggcctcccctgcgcgcagctacccgggcgtcccggcccgcggccccgctaaccccggggcccgcgcccccgcggcagggatgcatcatggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 11160 - DNA, 4891 bp, Homo sapiens
gctgcggctgcggcctcccctgcgcgcagctacccgggcgtcccggcccgcggccccgctaaccccggggcccgcgcccccgcggcagggatgcatcatggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 11161 - DNA, 4828 bp, Homo sapiens
gctgcggctgcggcctcccctgcgcgcagctacccgggcgtcccggcccgcggccccgctaaccccggggcccgcgcccccgcggcagggatgcatcatggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 11162 - DNA, 1316 bp, Homo sapiens
aatcattagagcctgagtcactctccccaggagacccagacctagaactacccagagcaagaccacagctggtgaacagtccaggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagccacaggcatttcctgcttattttaggattacccactcatcagaaaaaaaaaaaaaagcctttgtgtcccctgatttggggagaataaacagatatgagttt

SEQ ID NO: 11163 - DNA, 1965 bp, Homo sapiens
attagagcctgagtcactctccccaggagacccagacctagaactacccagagcaagaccacagctggtgaacagtccagcctgtctccagttggactagccacaattcaagtgcttgaaaaccacatgtggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagccacaggcatttcctgcttattttaggattacccactcatcagaaaaaaaaaaaaaagcctttgtgtcccctgatttggggagaataaacagatatgagtttattattgacttcttttttgattttggacctcagccttgggtggtcagggtgggaaatgataggaagaagctgtcatctgcatcctagtttgcctgaaatgaacccaaataatacccattattattagtcctgaattatgagtagtgaatgatacccatcattctggcatcatgatgagtagtgtccacttccattctgaaaagtgccctgctgtgaaaaataaattatatagtcatcctaggtaaatgaaggaggagggagaagtgtgaaagagtatggcttaaatcagacaagatatacaagaagatactttatatagggcaggagcggtggctcatgcctgtaatcccagcactttgggaggccgaggcaggcggatcaccaggggtcaggaattcgagaacagcctggccaacatggtgaaaccctgtctctactaaaaatacaaaaattagctgggcgtagtggcaggctcccgtaatcccagctactcaggagaccgaggcaggagaatcgcttgaacctggaaggcggaggttgtagtgagccaagaaaacgccactacactccagcctgggtgacagagagagactccggctcag

SEQ ID NO: 11164 - DNA, 2164 bp, Homo sapiens
gaaggaagggctggacattcagattccttgacccttgacatttggaagcatgaactccagtctctcacagaaggctagaggtgaaggaacattcagacacattggtttctaagaagagtccgctgacaacatacccaaggtgtcttctgaaaattataagaaatcctgagtttctgttaggggattggctccagctccattgtccctcccccatcattcagtagtctccgcgaaagcccttagagccggtgttgctccacaggaagccaagaagcacacaggaaaaggagcttagctgctggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattc

SEQ ID NO: 11165 - DNA, 2621 bp, Homo sapiens
ggaccaggaacaacctatttgcaaagttggcgcaaacattcctgcctgacaggaccatggacacaggttgtagagatagagatggctctggctgtgcattcagcagattctgtagatagaattaataggacttggatgggattgtggtgagagaaagtgaaatgaaagataagttctagtttggaagttttaacaactgaatgtttaaactcaaatagacacaaaatattggaagagtggcaggtttgggaggatgagacaatcaactgtttggttgagccacgttaggtttgaaatgtctacgggactcccgtggggagaggttatatcagactggagcaccagagagaggccaaggctgatagtttagatgaaaagagagcatgatattttaagccctgagactggataatatcacctatagaaagactatatagagataagagaggtggggaacaagtaaaagctgcgggacactcctaaatttagagtcaaatttagagcagaaaatactagcaaaggggactgaaaagcggtggccaattgagcttcaaatgcaagtgaaagtgtgttgtgtgtacatttatcatctcatggcacaggaaaaacgtgatttaaggagaaggaagcgatccaatgggaagaagagatccaatggatcctctatcacgaagatattgagataagaaccaatatggatttgcacccactgcatttgcagccttgaggtcataagcatcctcaggaaaatgcaccaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattc

SEQ ID NO: 11166 - DNA, 2517 bp, Homo sapiens
aaaacactcattttgttttatagcatgacaggctgtctgattccatctttataaccaaagccaattaagatcttaaaaccaaacatataacttcatctttttacaagtacttagagcctgagttgctccacaggaatccaggaactgggcacaggaaaaggatctaagctggtggtgtgggaagatggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttggctcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcagcgtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacagacaccacttctgcttcacctcctgaggagacggagttacaagcaatgtgaggtcggggatatttttgggctctgtctctttctaccctgcgttaagcggaaaaaaaaaattctgacagtgtttttcttcctctttcataccaccaccaccacaatcatcaacataaaggaagtctgtaccaaatctgtagggggtttttcccacaaccaagcaatagacaccagctgggtgtcctacaattaaattccaacactatctacctggagctactgtcagatcccacaggtttaagggctcattccccaagtctgctcctccagttgagacacaagtcacaaatccaggcttctgaaacttcggaccaaccagcttcaatcagggttcccactaccccctctttgggggtagagtggctcatggaactcagagaaacatttatttcggcttgctggtttattataaaagcaaggtttattataaaagatactacaaaggatacagatgaagaggcacatagggcaaggtacggggttccacgccctccctgagtgcatcaccctctgggaacctccgtgtgttcacgtctcatgaagctctccaaatccagtcctcttgggtttttatggaagcttcatgatgtcagcattctttcctccagtgtataggatgggatcctctctggggagggtcttaagacccacaattagaaaggcaagggaagattagagtcctgctttggggtagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccataggctttctggggctttctctttttaaagtcagactgttgaaggtttcttctattcttatttgttaagagttttcttttattgtttaaatcatgaatgaatgttgaattttattaaatgcagtttctgtaaatatt

SEQ ID NO: 11167 - DNA, 1669 bp, Homo sapiens
acgggccaaggcggcgcgtctcgggggtggagcctggaggtgaccgcgccgctgcaacgcccccaccccccgcggtcgcagtggttcagcccgagaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtgg

SEQ ID NO: 11168 - DNA, 1427 bp, Homo sapiens
ataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcaggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtggcctgagtgcctcactggacccagaggccaatgggagagtatttggagccctaggtcccagccttagctctacagactcactgcatgaccttggacaaattctttgatatttttggactttgtcttatctgacaagtggggctacatccgctcggcctcatctccgggactg

SEQ ID NO: 11169 - DNA, 970 bp, Homo sapiens
gagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtggcctgagtgcctcactggacccagaggccaatgggagagtatttggagccctaggtcccagccttagctctacagactcactgcatgaccttggacaaattctttgatatttttggactttgtcttatctgacaagtggggctacatccgctcggcctcatctccgggactgaggggagacagtcctctggggtaaaagcga

SEQ ID NO: 11170 - DNA, 6708 bp, Homo sapiens
gtagtgactcatctcgggcagagcgctagggctccgagcgaaccagcgagcgagcgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaa

SEQ ID NO: 11171 - DNA, 983 bp, Homo sapiens
atagacgcctgcccattcggcccggcagtgtgtgaggcgcctttcaaaccggagggattggcaagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctc

SEQ ID NO: 11172 - DNA, 2458 bp, Homo sapiens
caaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11173 - DNA, 1017 bp, Homo sapiens
atttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtga

SEQ ID NO: 11174 - DNA, 833 bp, Homo sapiens
gtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctc

SEQ ID NO: 11175 - DNA, 2565 bp, Homo sapiens
gccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11176 - DNA, 2441 bp, Homo sapiens
cccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11177 - DNA, 2374 bp, Homo sapiens
taacaatgctgagtgtttgagctaatacggcttgataatgagggagccagatccactgccagtgctcatgttatatgataaacagacatttggagaagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11178 - DNA, 2706 bp, Homo sapiens
cccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11179 - DNA, 926 bp, Homo sapiens
gcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggagg

SEQ ID NO: 11180 - DNA, 796 bp, Homo sapiens
aggcagtctgactctggtgcccctgctgtgaagagctgtgccctgctgcattcctcctgtagctgcacgaaagggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtatt

SEQ ID NO: 11181 - DNA, 539 bp, Homo sapiens
tttttccctaacttaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttc

SEQ ID NO: 11182 - DNA, 796 bp, Homo sapiens; identical to SEQ ID NO: 11180

SEQ ID NO: 11183 - DNA, 2297 bp, Homo sapiens
atgagccatttcatacttaggcaccttggaagttgttttcaaccatatccagcctttgccgaatacatcctatctgccacacatccagcgtcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11184 - DNA, 775 bp, Homo sapiens
gagggagccagatccactgccagtgctcatgttatatgataaacagacatttggagaagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggacca

SEQ ID NO: 11185 - DNA, 601 bp, Homo sapiens
tagcaggggctgtggggagcgggtgaggatgaagcggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgag

SEQ ID NO: 11186 - DNA, 2437 bp, Homo sapiens
acagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11187 - DNA, 1432 bp, Homo sapiens
agtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcagg

SEQ ID NO: 11188 - DNA, 2313 bp, Homo sapiens
agcgttaagctatgccagagccgagtccaaattttattccggtacagggatgactttctatgtggcctctctggctctggagctaatttggatgctgagtagccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11189 - DNA, 969 bp, Homo sapiens
atcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaata

SEQ ID NO: 11190 - DNA, 2888 bp, Homo sapiens
acacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 11191 - DNA, 1462 bp, Homo sapiens
gcagcgctccactcggccggcagcggagccgcagccaccagccgcccgcgccctccagccccgtccgggagtccccggcccgctgcggtgcctggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacag

SEQ ID NO: 11192 - DNA, 1241 bp, Homo sapiens
cagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacag

SEQ ID NO: 11193 - DNA, 1769 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactgtggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaatcttttgccaggca

SEQ ID NO: 11194 - DNA, 1872 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactgtggctgagaactgtgtcttcctggagactaggctggcattttgactttgggacggagtctcgctttgtcgcccaggctggagtgcagtggcacgatctcagctcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaac

SEQ ID NO: 11195 - DNA, 1426 bp, Homo sapiens
cagctgcacagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 11196 - DNA, 1531 bp, Homo sapiens
actcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 11197 - DNA, 1367 bp, Homo sapiens
ctcggccggcagcggagccgcagccaccagccgcccgcgccctccagccccgtccgggagtccccggcccgctgcggtgccgttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaaga

SEQ ID NO: 11198 - DNA, 4881 bp, Homo sapiens
actttggttttcccgccctggaggggaatccaagatgtctaactagtcttctggccccgagagggagaggtggggataggaccttcctttagtcccctccgtagtggaacgaaggattctttatggtcatctgtggtgttcatttcgtaaagaagcatctgcagggtaagaaggaaaaacgtccaccttgcaaatatatcccaggcacatgcctcctgagaagtgaccccctcctccctccgcctcccccggcacgtcctggggcttctccagtctcccgctcctgggaccaggcagagatcccggcgtgggcagacccctgccaccgcgcccaggcctcgtccgaaactcgcgcccgagagcccacgccggaggcgacgctcccgataactactgtgctcccaagacccggagggcacgaagaaaggagccctggcaaacaaagggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaatcttttgccaggcacagagtgtgaaatcatgattacaggtcgaggcactgagtctaagtaacactttattgcatggtcccatggtcactgtatgaagtgcagttccaatgttccaatggcctggggcattgccaactggaacagcatcacaccctttaaaggaagccttcggctgggcacggtggctcacgcctgtaatcccagcactttgggaggccaaggcgggtggatcatgaggtcaggagatcaagaccatcctggctaacatggtgaaaccccgtctctacgaaaaatacaaaaaattagccgggtgtggtggtgagcgcctgtagtcccagctactcgggaggctgaggcaggagaatggcatgaacccgggaggcagagcttgcagtgagctgagatggcaccactgaactccagcctggaagacaaagagactccgtctcaaaaaaaaaaagccttcagtcagcaccaggcacctcttccttgctaccttctctcccttttttttttttttttttgagacagagtctcgctctgtcgcccaggctaaagtgcaatggcacaatctcagctcactgcaacctccacttcccgcgttcaagcgattctcctgccctcagcctcctgagtagctgggattacaggcacccaccattatgcccggctaatttttgtatttttagtagagatggggtttcaccatgttaggctggtcttgaactcctgacctcaggtgatccacctgcctcggtcccccaaagtgctgggattataggcatgagccaccgcacccagctaccttctctgtctttcccatactctttctcttggaatgtaatcctctgcatttgacacagtaacataaactgacagtgaagccaattttcaggtcatttttcttggcagagcttatcggctctgtcccagtgttatggatccacatcttacaccgacttccataaagtgaaagattgcacaaggacataagcaacttgaggccagagacgacatcctgttcatctttatgttctcaacaccctcgcaactgagggcacactgggagccttcagtgtttctgaaaagggcagtaaagcaggagagacacacagtcattacagtaaaaataacattctgagctactagtgtggcagtagtctgtggaataatctcagatagcagtatacagttgggaagcacggagccaatgtatgggatagaacattgcacagttctctttagaatgggagcatcagtgacctttttgtccttagttttctaagacaatgcaatataataaaatgataggctgagcaacagaaaaatttggtggaaatcaagtctgatatatgctgagcatatgtgaaatcagtttcttaatctgagtgttagtcactgttagaatgtttgataatgtctggaatgagtcttttggttttatagttgacttgaggttttgcttaaaaagaataatttcatcctttgttagttgttttgctgttttctacttcataatataaaagtaaaagcactccaaatttcattttggaacatcttacttgttcctcattaaaaccatagactctcccaaccttaaattacccattctaaaattaatggttagggggaattccacttctagtaaatagctccaattggactaattctcctccaaattaacagtcattctggacaaaatatttatttaattgttaagaacactggagcacgatccaaagcaggcagatattggagggcagtagacacttggaagaagagaacgacactgggtgattttcctgtttcggccttttatccaatggcaggcccccgccagggatctaaaactctgttaggaaacctgcagtcttactggcctgaggaaccagaggccagagttcgggacaaacagcctctggaaagtgaggaagaaaatcctgaaaaggagagccccaagttcgtcgcatgaacttagaaatttctggctgacaactgaaccgtgtatacttaggccagactccaagcagcccagccaaggctaaaagcattgactgacaggactttacagatagtggtttgcagggcttagctgaccgaccctcttcctactgaaggaaattacttgtatataaaccacacaacacaaagtctctgaaaatttccccagaagcatacaacaaataaacattcattcaggaaaatccactactaagtcttagaaagaacagtgagtctgtggcatttgagccacagcctcatcctatcccatccccactccccagcttcatgtgacaaactctattctggaccaatgcagccaaaaattaaggggtctctcttcctccagctaccagtctagggctttgccccaggtgcgacaggctgagaatcgtagagctccaattgcccctaccctagcctgcttagtgcggaggctccacattgggaggggcaatctgagaagaccagcggctatcaacccactcacagagaagggatgtcagtcctggagaagcaggctgctgtccagcccccagaggagatccaggctctgagactggtaacccagcagttatgcccaaggggactggtatttggtacggagaacgagaaatctttgcctaaggggattgtcaaaaacaataagacatcttaccagtgagccattaaggaaggggctggtaactccatgctattagtagcaaaaagcaaaatgacagaccagccagaagtttaacacagaaaaccagagaaagagatagccaagaagagccctcctggaatctggtttatccttgaggttcgggaagtatgtatggacagggctgtatccactcaggagcaatcagatgtgaaacaaacttgaaagcattctctaaggcatacacagatccatcagcaaagagcagaaatcttattagctcaaagtgcttaagcagaacctctgaccaaacactggctgaacacataaatgtgtttgttcaaagaactaaaggaaatcatatttaaaaaaggaaggtaaaggaacaattacagttgttcctccatatccatggattcctcatctgtggattcaaccaactgtggatcaaaagtatttaggaaaaaaaa

SEQ ID NO: 11199 - DNA, 1601 bp, Homo sapiens
tcagcctcagtgactcaggcagcctcctttgtcagcaccgggcctgagtcgctaagcggctctctgactcagatgccctgaggtacaaagttccttgagcttgggtgaatggaaacattagacattgggttcttctgtgcggttttattatgagaatttgatcaaagccacatttattaagtgtccatctcaagttgcattatactgagttcgcttcctcaagatgaccatctgaaacaaaacacgtgtgctttctctagtggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattat

SEQ ID NO: 11200 - DNA, 574 bp, Homo sapiens
tttattaagtgtccatctcaagttgcattatactgagttcgcttcctcaagatgaccatctgaaacaaaacacgtgtgctttctctagtggctgagaactgtgtcttcctggagactaggctggcattttgactttgggacggagtctcgctttgtcgcccaggctggagtgcagtggcacgatctcagctcactgcaagctctacctcttggttcacgccattctcctgccccagcctcccaagtagctgggactacaggtgcccgccaccacacccggataattttttttttgtatttttagtagagatggggtttcaccgtgttagccaggatggtctcaatctcctgacctcgtgtttcacccgcctcagcctcccaaagtgctgggattacaggcgtgagccaccgcacctggccagattttttttgtttttgtttttttctgtcctggtcctgtagaatcagaggaagtggaaaacacatatcaggttgctgaaaagccaggagtcaaaatgactgagcgctttgactgccaccattgcaacgaatctctctttggcaagaagtacat

SEQ ID NO: 11201 - DNA, 1876 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactgtggctgagaactgtgtcttcctggagactaggctggcattttgactttgggacggagtctcgctttgtcgcccaggctggagtgcagtggcacgatctcagctcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 11202 - DNA, 1647 bp, Homo sapiens
cacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccagggccccaaacctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 11203 - DNA, 2031 bp, Homo sapiens
tgcaagtccagagagcagggaactaccttgagtattctactcaaacttatgtctcagagttccccaatttcccaagaagggagagatagaggccacaatccagggggccatctcttaaggtaccaataattttgcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaa

SEQ ID NO: 11204 - DNA, 779 bp, Homo sapiens
tgcaagtccagagagcagggaactaccttgagtattctactcaaacttatgtctcagagttccccaatttcccaagaagggagagatagaggccacaatccagggggccatctcttaaggtaccaataattttgcaggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgc

SEQ ID NO: 11205 - DNA, 1904 bp, Homo sapiens
aggaagcaggcagagcggggaaggctgagtccacactgcaagtccagagagcagggaactaccttgagtattctactcaaacttatgtctcagagttccccaatttcccaagaagggagagatagaggccacaatccagggggccatctcttaaggtaccaataattttgcaggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatctt

SEQ ID NO: 11206 - DNA, 2685 bp, Homo sapiens
tacgccccggcgcgggcgcagccagtccggcttcctccaggcccccaagtcccggaccgagtgtggggccgcctctccctctcggaaggagccatcgccgctttaagtggaagaggagaggaagggggcgggggagcggggggcggggagcggaggcggaggagggggagggggatccccctggctcccacgtggtccgggcgcctgtgaatcgcgcccaccggagggtctcacagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaaaaacttcagcttttcacccacctgcccctttctttcaatcccacgctgtttcctttcaaagttctgggaggacgaactcaccgaggcgagaagtgtaacattctctccacccagcttataaaaggattctttactgtgccagcacggggattggatccgaagaaactggctactggggtttggcccccgagtggccgtccctgtgggagatgcaccccattcttgggccccccctcattccctttccgaaaaaggaaaacttgcgtttgagccgttgagctaattctgcaattttctaccaaacagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaagggagtttaaaatttataattt

SEQ ID NO: 11207 - DNA, 2840 bp, Homo sapiens
gagaggttacttccggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaacaaaggtctgtgtggttgtcttcacgggcaatcaggaagggagagagctggggaccatattctgcaatgcagccaaatccgaggaagagaaactgaagggagaagtagatggcaatggttatgataaaaagggataaaactaaatcttcgggacttctttaatgctacgttaatgtttcactgctcgtctagaaactcctaaatccagctttctatcatctgccccacattggtcccattgagtacattctgtgatttctaattccagcctctccattcttttctcattattgcctcccccgccccccaactttgtgtaatttacttctgtattcagcagcctggatagcatatcattccatcaccccattttcttgccaccattggccatctttttgtatcattccacttattctgtcttttccattccttcattcaaactgctagagaaaaacagttgtgtaatgaatgccactaaatattcaaggcctccaacctcagccaagtcctcacaccaacacgcagtcacaccaacacacacctttatgggttcctggtccatttccttctctaattaccatggcagttattttacacctctactgctgtccttaatcccataccccaccctcatcaggtgaccctgtttccttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatctttacaacaactataagtaagaggtattaacctcacttaacagatgaggaagcaagaatccagaatgtgccagaaggcacattctgcagatttcgtgcaaacatttatacacagcttcttttttttttttttgagacagagtctcgctctgtcacccaggctggagtgcagtggagcgatctaggctcactgcaacctccgccacccgggttcaagcagttctcctgcctcagcctctcgagtagctgggattacaggcatgcgccaccacgcccagctaattttgtttttgtattttaagtagagacggggtttcactgtattggtcaggctggtcttgaactcctgaccttgtgatccgcccgcctcggcctccaaaagtgctgggattacaggtgtgagccaccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattgtgaat

SEQ ID NO: 11208 - DNA, 595 bp, Homo sapiens
atgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggcgatcgccagctcgagtgcagattccttgctgtgaccgaggttcagagtgagctctgtcggtgtgtcagtttgcctcttcaggtgaggccccgcatctggcatcctggaactggcagttggagcctgagctatgggcaaggtcacttcgacagcagttgaatgcccagctcctcatggtcccggaggagaggagggta

SEQ ID NO: 11209 - DNA, 608 bp, Homo sapiens
ggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttgggagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 11210 - DNA, 3089 bp, Homo sapiens
acccgtagggagaggcgggttgcgggcggcggcggcggcggcggcggcggtggtggttgtggcgaggctgtgcggcagggcgcacgggacctgtgctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctca

SEQ ID NO: 11211 - DNA, 1143 bp, Homo sapiens
acccgtagggagaggcgggttgcgggcggcggcggcggcggcggcggcggtggtggttgtggcgaggctgtgcggcagggcgcacgggacctgtgctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaagaatgttggaggaactgcagatgtttacctgggagaagagtgaaaggatgggagggaagagactaataatcattattggagaggagttgtctgctaatgtaactacttttaaaatg

SEQ ID NO: 11212 - DNA, 1140 bp, Homo sapiens
acccgtagggagaggcgggttgcgggcggcggcggcggcggcggcggcggtggtggttgtggcgaggctgtgcggcagggcgcacgggacctgtgctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttaatggagtcatgctctttcacccaggttggagtgcagtggcgcgatctcagctgactgcagcccctgcttcccaggttcaaactaataatcattattggagaggagttgtctgctaa

SEQ ID NO: 11213 - DNA, 1077 bp, Homo sapiens
acccgtagggagaggcgggttgcgggcggcggcggcggcggcggcggcggtggtggttgtggcgaggctgtgcggcagggcgcacgggacctgtgctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttaagacctacttcgttggattattatcagaatcaaatgagaaaacatacatgtaa

SEQ ID NO: 11214 - DNA, 1392 bp, Homo sapiens
gtagggagaggcgggttgcgggcggcggcggcggcggcggcggcggtggtggttgtggcgaggctgtgcggcagggcgcacgggacctgtgctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttaactaataatcattattggagaggagttgtctgctaatgtaactactttgaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaa

SEQ ID NO: 11215 - DNA, 4333 bp, Homo sapiens
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatg

SEQ ID NO: 11216 - DNA, 1295 bp, Homo sapiens
ggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtagggttgaagatctgaacataggttacttaaatctaaaaagtcccaaagctagaagaaacttcagatgtctctgggactttctgcaaagtcaatagtaattctccattttgacttgagtagtgttttatcaccatcaccatcgtgagtatcagcaaatatttaggagctcttcaccaatactcctaaatgctgcagatatctttagtagaacatatcaaaaccaggtgcagttttatcaagaaagctacatatgtttttaatttgtaaataaaattgggacatactgcc

SEQ ID NO: 11217 - DNA, 1774 bp, Homo sapiens
atggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaa

SEQ ID NO: 11218 - DNA, 4125 bp, Homo sapiens
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatg

SEQ ID NO: 11219 - DNA, 4308 bp, Homo sapiens
ggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaa

SEQ ID NO: 11220 - DNA, 3437 bp, Homo sapiens
gggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgca

SEQ ID NO: 11221 - DNA, 3699 bp, Homo sapiens
ggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgcta

SEQ ID NO: 11222 - DNA, 1853 bp, Homo sapiens
gtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtagggttgaagatctgaacataggttacttaaatctaaaaagtcccaaagctagaagaaacttcagatgtctctgggactttctgcaaagtcaatagtaattctccattttgacttgagtagtgttttatcaccatcaccatcgcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcatt

SEQ ID NO: 11223 - DNA, 3277 bp, Homo sapiens
aaagccggtgatgcagggtgcgcagggatcccacctggagagtcggggcggcacgttgagaccccaggggtgaagggcgggggatcccaatcccagccctgttttcccctcccctttccccgcctccttctcgcccctcccccctcctcccctctggttggaaagtttctagaatctcttcccagcggcctttgcggttccaacatggcggagctgacggtggaggttcgcggctctaacggggctttctacaagtcaattcacaatgaatcaaatgtccccattttggaactctgaagtatttataattgatctctatacatatctacaatctactgcttgtttctacttagactttgactccattactcattttgcctcacaaagtgagttggtactttgacaaaggttggaaaggacactagccacctgtgtgtgcactgaaatcatgtacgcttgaacatttggaattttatgtccagccataatccacttgcatatgcactttgtggaaactgtggtcttcagaactctggaagaatgagaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatt

SEQ ID NO: 11224 - DNA, 3120 bp, Homo sapiens
atgccgatgcgccgggcaggctgtgcctgggcagttcattctgtggcagctggaggcactactcggccgccgcggtgcgaactgcgggcactgtggggcggagacctaggggcgggtcaacaaaggtcgggcgattgtgtctggaggcaaatccgacgtagacggcggcaggcggagcccaaagccggtgatgcagggtgcgcagggatcccacctggagagtcggggcggcacgttgagaccccaggggtgaagggcgggggatcccaatcccagccctgttttcccctcccctttccccgcctccttctcgcccctcccccctcctcccctctggttggaaagtttctagaatctcttcccagcggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatttgctgaa

SEQ ID NO: 11225 - DNA, 2651 bp, Homo sapiens
tttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatt

SEQ ID NO: 11226 - DNA, 1996 bp, Homo sapiens
gtgtagtgttttgagtccggcttccatttagcgtagaagcaatttaattttaattagtttttttccaatttagaagataatacatggtcactgagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcg

SEQ ID NO: 11227 - DNA, 2987 bp, Homo sapiens
gcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggcaaagtgattggaaagaacgggaaagtgatccaggagattgtggataaatctggtgtggtgagggttcgagtggaaggtgataatgacaagaagaaccccagggaggagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc
